(12) United States Patent
Spangenberg et al.

(10) Patent No.: US 10,428,343 B2
(45) Date of Patent: Oct. 1, 2019

(54) MODIFICATION OF LIGNIN BIOSYNTHESIS VIA SENSE SUPPRESSION

(71) Applicants: Dairy Australia Limited, Southbank, Victoria (AU); Agriculture Victoria Services Pty Ltd, Attwood, Victoria (AU)

(72) Inventors: German Spangenberg, Bundoora (AU); Angela Jane Lidgett, Kew (AU); Robyn Louise Heath, Clifton Hill (AU); Russell Leigh McInnes, Bundoora (AU); Damian Paul Lynch, Northcote (AU); Ulrik Peter John, Westgarth (AU); Aidyn Mouradov, Mill Park (AU); Megan Elizabeth Griffith, Templestowe (AU)

(73) Assignees: Dairy Australia Limited, Southbank (AU); Agriculture Victoria Services Pty Ltd, Attwood (AU)

( * ) Notice: Subject to any disclaimer, the term of this patent is extended or adjusted under 35 U.S.C. 154(b) by 0 days.

(21) Appl. No.: 15/404,990

(22) Filed: Jan. 12, 2017

(65) Prior Publication Data
US 2017/0191075 A1    Jul. 6, 2017

Related U.S. Application Data

(63) Continuation of application No. 12/669,659, filed as application No. PCT/AU2008/001034 on Jul. 17, 2008, now abandoned.

(30) Foreign Application Priority Data

Jul. 19, 2007 (AU) ............................... 2007203378

(51) Int. Cl.
| | | |
|---|---|---|
| C12N 15/82 | (2006.01) | |
| C07H 21/00 | (2006.01) | |
| C12N 9/88 | (2006.01) | |
| C12N 9/04 | (2006.01) | |
| C12N 9/02 | (2006.01) | |
| C12N 9/10 | (2006.01) | |
| C12N 9/00 | (2006.01) | |

(52) U.S. Cl.
CPC ......... *C12N 15/8255* (2013.01); *C07H 21/00* (2013.01); *C12N 9/0006* (2013.01); *C12N 9/0008* (2013.01); *C12N 9/0073* (2013.01); *C12N 9/0077* (2013.01); *C12N 9/1007* (2013.01); *C12N 9/88* (2013.01); *C12N 9/93* (2013.01); *C12N 15/8251* (2013.01)

(58) Field of Classification Search
None
See application file for complete search history.

(56) References Cited

U.S. PATENT DOCUMENTS

| | | |
|---|---|---|
| 5,952,486 A | 9/1999 | Bloksberg et al. |
| 6,015,943 A | 1/2000 | Boudet et al. |
| 2005/0069884 A1 | 3/2005 | Spangenberg et al. |
| 2005/0091707 A1 | 4/2005 | Spangenberg et al. |
| 2005/0150008 A1* | 7/2005 | Demmer ............... C07K 14/415 800/284 |
| 2006/0101535 A1 | 5/2006 | Forster et al. |
| 2008/0034453 A1 | 2/2008 | Cheikh et al. |

FOREIGN PATENT DOCUMENTS

| | | |
|---|---|---|
| AU | 2005266924 A1 | 2/2006 |
| CA | 2782864 A1 | 5/2003 |
| CN | 1329663 A | 1/2002 |
| WO | 9305159 A1 | 3/1993 |
| WO | 9324638 A1 | 12/1993 |
| WO | 97012982 A1 | 4/1997 |
| WO | 9839454 A1 | 9/1998 |
| WO | 9910498 A2 | 3/1999 |
| WO | 9931243 A1 | 6/1999 |
| WO | 2001073090 A2 | 10/2001 |
| WO | 2001/095702 A1 | 12/2001 |
| WO | 2002/026994 A1 | 4/2002 |
| WO | 0226994 A1 | 4/2002 |
| WO | 03/040362 A1 | 5/2003 |
| WO | 2003040306 A2 | 5/2003 |
| WO | 2003105723 A2 | 12/2003 |
| WO | 2006104891 A2 | 10/2006 |
| WO | 2007/066214 A2 | 6/2007 |
| WO | 2008049848 A1 | 5/2008 |
| WO | 2008064289 A2 | 5/2008 |

OTHER PUBLICATIONS

Que et al 1997 The Plant Cell 9:1357-1368, provided in Applicants IDS (Year: 1997).*
Selman-Housein, Guillermo et al. "Molecular Cloning of cDNA's coding for three sugarcane enzymes involved in lignification", Plant Science, May 1999, pp. 163-171, vol. 143.
GenBank Accession No. AF153824, Auh, et al., Structure and expression of caffeic acid O-methyltransferase cDNAs from tall fescue (*Festuca arundinacea*), Jul. 1, 2001.
GenBank Accession No. AF153823, Auh et al., Structure and expression of caffeic acid O-methyltransferase cDNAs from tall fescue (*Festuca arundinacea*), Jul. 1, 2001.
Fukushima, R. S. et al, Extraction and Isolation of Lignin for Utilization as a Standard to Determine Lignin Concentration Using the Acetyl Bromide Spectrophotometric Method, Journal of Agricultural and Food Chemistry, Jul. 2001, pp. 3133-3139, vol. 49, No. 7.

(Continued)

*Primary Examiner* — Brent T Page
(74) *Attorney, Agent, or Firm* — Larson & Anderson, LLC

(57) ABSTRACT

The present invention relates to the modification of lignin biosynthesis in plants, to enzymes involved in the lignin biosynthetic pathway and nucleic acids encoding such enzymes and, more particularly, to methods of modifying lignin biosynthesis via sense suppression and to related nucleic acids and constructs.

9 Claims, 92 Drawing Sheets

Specification includes a Sequence Listing.

(56) References Cited

OTHER PUBLICATIONS

Que, Q. et al., The Frequency and Degree of Cosuppression by Sense Chalcone Synthase Transgenes Are Dependent on Transgene Promoter Strength and Are Reduced by Premature Nonsense Codons in the Transgene Coding Sequence, The Plant Cell, 1997, pp. 1357-1368, vol. 9.

Indian Examination Report dated Feb. 9, 2016 from related Indian Application No. 317/KOLNP/2010.

GenBank Accession AF278698, Larsen, K. "Cloning and Characterization of a ryegrass (*Lolium perenne*) gene encoding cinnamoyl-CoA reductase (CCR)" Mar. 26, 2004.

GenBank Accession AY061888, McInnes, R. et al. "Isolation and characterization of a cinnamoyl-CoA reductase gene from perennial ryegrass (*Lolium perenne* L.)" Dec. 26, 2001.

Somssich, I. et al. "*Arabidopsis thaliana* defense-related protein ELI3 is an aromatic alcohol:NADP+ oxidoreductase" PNAS, Nov. 1996, pp. 14199-14203, vol. 93.

Sundaresan, V. et al. "Patterns of gene action in plant development revealed by enhancer trap and gene trap transposable elements" Genes and Development, 1995, pp. 1797-1810, vol. 9.

Zubieta, C. et al. "Structural Basis for the Modulation of Lignin Monomer Methylation by Caffeic Acid/5-Hydroxyferulic Acid 3/5-O-Methyltransferase" The Plant Cell, Jun. 2002, pp. 1265-1277, vol. 14.

Goderis et al., "A set of modular plant transformation vectors allowing flexible insertion of up to six expression units", Plant Molecular Biology, 2002, pp. 17-27, vol. 50.

Liyama et al., "Determination of Lignin in *Herbaceous* Plants by an Improved Acetyl Bromide Procedure", J Sci Food Agric., 1990, pp. 145-161, vol. 51.

Lichtenstein et al., "Genetic engineering of plants", bk: DNA Cloning vol. II, 1985, pp. 67-119, IRL Press, Washington.

Moore et al., "Describing and Quantifying Growth Stages of Perennial Forage Grasses", Agron. J., 1991, pp. 1073-1077, vol. 83.

Rolando et al., "Thioacidolysis", Methods in Lignin Chemistry, 1992, pp. 334-349, Springer-Verlag.

Spangenberg et al. "Transgenic Tall Fescue (*Festuca arundinacea*) and Red Fescue (*F. rubra*) Plants from Microprojectile Bombardment of Embryogenic Suspension Cells", J. Plant Physiol, 1995, pp. 693-701, vol. 145.

Larsen, K., et al., "Lolium perenne cinnamoyl CoA reductase (CCR) mRNA, complete cds", EMBL, XP-002166672, Sep. 5, 2000, pp. 1-2.

Larsen, K., "Cloning and characterization of a ryegrass (*Lolium perenne*) gene encoding cinnamoyl-CoA reductase (CCR)", Plant Science, Mar. 2004, pp. 569-581, vol. 166, No. 3.

Larsen, K., "Cloning and characterization of a ryegrass (*Lolium perenne*) gene encoding cinnamoyl-CoA reductase (CCR)", Database ID Q9FUW8, XP-002298872, Mar. 1, 2001.

McInnes, et al., "Isolation and characterization of a cinnamoly-CoA reductase gene from perennial ryegrass (*Lolium perenne*)", Journal of Plant Physiology, Apr. 2002, pp. 415-422, vol. 159, No. 4.

Lacombe et al., "Cinnamoyl CoA reductase, the first committed enzyme of the lignin branch biosynthetic pathway: closing, expression and phylogenetic relationships", The Plant Journal, Mar. 1997, pp. 429-441, vol. 11, No. 3.

Piquemal, et al, "Down-regulation of Cinnamoyl-CoA Reductase induces significant changes of lignin profiles in transgenic tobacco plants", The Plant Journal, 1998, pp. 71-83, vol. 13, No. 1.

Tavares, et al., "Organization and structural evolution of four multigene families in *Arabidopsis thaliana*: AtLCAD, AtLGT, AtMYST and AtHD-GL2.", XP-002310805, Aug. 1, 1998.

Tavares, et al., "Organization and structural evolution of four multigene families in *Arabidopsis thaliana*: AtLCAD, AtLGT, AtMYST and AtHD-GL2", Plant Molecular Biology, Mar. 2000, pp. 703-717, vol. 42, No. 5.

Halpin, et al., "Manipulation of lignin quality by downregulation of cinnamyl alcohol dehydrogenase", The Plant Journal, 1994, pp. 339-350, vol. 6, No. 3.

Baucher, et al., "Higher extractability of lignin in poplar (populus tremula x P. Alba) by reducing cinnamyl alcohol dehydrogenase activity", Somatic Cell Genetics and Molecular Genetics of Trees, 1996, pp. 153-158, XP002065203.

Chen, et al., "Lignin deposition and associated changes in anatomy, enzyme activity, gene expression, and ruminal degradability in stems of tall fescue at different developmental stages", Journal of Agricultural and Food Chemistry, Sep. 25, 2002, pp. 5558-5565, vol. 50, No. 20.

GenBank Accession No. AF153826, Auh, et al., "Structure and Expression of Caffeic Acid O-Methyltransferase cDNAs from Tall Fescue (*Festuca arundinacea*)." Forge Biotechnology Group. May 25, 1999. <http://www.ncbi.nlm.nih.gov/entrez/viewer.fcgi?db=nucleotide&val=14578616>.

GenBank Accession No. AF153823, Auh, et al., "Structure and Expression of Caffeic Acid O-Methyltransferase cDNAs from Tall Fescue (*Festuca arundinacea*)." Forge Biotechnology Group. May 25, 1999. <http://www.ncbi.nlm.nih.gov/entrez/viewer.fcgi?db=nucleotide&val=14578610>.

GenBank Accession No. AF153825, Auh, et al., "Structure and Expression of Caffeic Acid O-Methyltransferase cDNAs from Tall Fescue (*Festuca arundinacea*)." Forge Biotechnology Group. May 25, 1999. <http://www.ncbi.nlm.nih.gov/entrez/viewer.fcgi?db=nucleotide&val=14578614>.

GenBank Accession No. AF153824, Auh, et al., "Structure and Expression of Caffeic Acid O-Methyltransferase cDNAs from Tall Fescue (*Festuca arundinacea*)." Forge Biotechnology Group. May 25, 1999. <http://www.ncbi.nlm.nih.gov/entrez/viewer.fcgi?db=nucleotide&val=14578612>.

Darbyshire, S.J., "Lolium arundinaceum", Downloaded on Oct. 3, 2006 from URL: <http://www.itis.gov/servlet/SingleRpt/SingleRpt?search_topic=TSN&search_value=507979>.

Heath, et al., "cDNA Cloning and Differential Expression of Three Caffeic Acid O-Methyltransferase Homologues from Lolium perenne." Plant Sciences & Biotechnology. Nov. 10, 1997. <http://www.ncbi.nlm.nih.gov/entrez/viewer.fcgi?db=nucleotide&val=4104219>, Accession No. AF033539.

McAlister, et al., "Perennial ryegrass (*Lolium perenne*) CAD cDNA sequence" CSIRO Plant Industry, Jun. 16, 1997, <http://www.ncbi.nlm.nih.gov/entrez/viewer.fcgi?db=nucleotide&val=2388662>, Accession No. AAB70908.

Wikipedia. "Regulatory sequence." Downloaded on Sep. 8, 2006 from URL: <http://www.en.wikipedia.org/wiki/Regulatory_sequence>.

Civardi et al., "Molecular Cloning and Characterization of Two cDNAs Encoding Enzymes Required for Secondary Cell Wall Biosynthesis in Maize.," NATO Asi Series, 1998, pp. 135-146, H 104.

GenBank accession AF052223, Heath, et al., "Isolation of three 4-coumarate—CoA ligase cDNA homologues from Lolium perenne", Mar. 7, 2000.

GenPept accession AAF37734, Heath, et al., "Isolation of three 4-coumarate—CoA ligase cDNA homologues from Lolium perenne", Mar. 7, 2000.

GenBank accession AF052222, Heath, et al., "Isolation of three 4-coumarate—CoA ligase cDNA homologues from Lolium perenne", Mar. 7, 2000.

GenPept accession AAF37733, Heath, et al., "Isolation of three 4-coumarate—CoA ligase cDNA homologues from Lolium perenne", Mar. 7, 2000.

GenBank accession AF052221.1, Heath, et al., "Isolation of three 4-coumarate—CoA ligase cDNA homologues from Lolium perenne", Mar. 7, 2000.

GenPept accession AAF37732, Heath, et al., "Isolation of three 4-coumarate—CoA ligase cDNA homologues from Lolium perenne", Mar. 7, 2000.

Pichon et al., "Cloning and characterization of two maise cDNAs encoding Cinnamoyl-CoA Reductase (CCR) and differential expression of the corresponding genes," Plant Molecular Biology, 1998, pp. 671-676, vol. 38.

(56) References Cited

OTHER PUBLICATIONS

GenBank accession AJ231134, Selman-Housein et al., "Molecular cloning of cDNAs coding for three sugarcane enzymes involved in lignification," Jan. 25, 2000.
Baucher, et al., "Down-regulation of cinnamyl alcohol dehydrogenase in transgenic alfalfa (*Medicago sativa* L.) and the effect on lignin composition and digestibility," Plant Molecular Biology, 1999, pp. 437-447, vol. 39.
GenBank accession AF010290, McAlister, et al., "Perennial ryegrass (*Lolium perenne*) CAD cDNA sequence" Sep. 23, 1997.
GenPept accession AAB70908, McAlister, et al., "Perennial ryegrass (*Lolium perenne*) CAD cDNA sequence," Sep. 22, 1997.
Heath et al., "cDNA Cloning and Differential Expression of Three Caffeic Acid O-Methyltransferase Homologues from Perennial Ryegrass (*Lolium perenne*)," Journal of Plant Physiology, 1998, pp. 649-657, vol. 153.
GenBank accession AF033540, Heath et al., "cDNA cloning and differential expression of three caffeic acid O-methyltransferase homologues from Lolium perenne", Jan. 29, 1999.
GenBank accession AF033539, Heath et al., cDNA cloning and differential expression of three caffeic acid O-methyltransferase homologues from Lolium perenne, Jan. 29, 1999.
GenBank accession AF033538, Heath et al., cDNA cloning and differential expression of three caffeic acid O-methyltransferase homologues from Lolium perenne, Jan. 29, 1999.
GenBank accession AF010291, McAlister, et al., "Sequence and expression of a stem-abundant caffeic acid O-methyltransferase cDNA from perennial ryegrass (*Lolium perenne*)", Jun. 3, 1998.
Capellades, et al., "The maize caffeic acid O-methyltransferase gene promoter is active in transgenic tobacco and maize plant tissues," Plant Molecular Biology, 1996, pp. 307-322, vol. 31.
Van Der Rest B et al., "Down-regulation of cinnamoyl-CoA reductase in tomato (*Solanum lycopersicum* L. induces dramatic changes in soluble phenolic pools.", J. Exp Bot., 2006, pp. 1399-1411, vol. 57, No. 6.
McAlister FM et al., "Sequence and expression of a stem-abundant caffeic acid O-methyltransferase cDNA from perennial ryegrass (*Lolium perenne*).", Aust. J. Plant Physiol., 1998, pp. 225-235, vol. 25 see also Genbank Accession No. AF010291, Jun. 3, 1998.
Chinese Office Action dated Dec. 5, 2018 with accompanying Search Report from corresponding Chinese Patent Application No. 2016105329599.

\* cited by examiner

```
     CGGCACGAGTGGACTTTCCGACGCCGGAGTCGCCGATGATGACCGCCTTGAGGAGGTAGT
  1  ---------+---------+---------+---------+---------+---------+  60

CGTAGTCGTCCTCCGCCCTGTACGCGCCGCTGCCCGCCATTTCCTTCCTCGCCTCGCGGG
 61  ---------+---------+---------+---------+---------+---------+  120

TCCTCCTCCCCGACCTGCGCTAGGCTCTGGATCTCGCGGGGTTTGGGCGCGGCGTCCTCG
121  ---------+---------+---------+---------+---------+---------+  180

CTGTGAGCTCGTGCCGAATTCGGCACGAGCCACCTTCGAGGCGTGCACTGGTACGAGCTC
181  ---------+---------+---------+---------+---------+---------+  240

GCGAGCCATTGTCAGTGCAGTGTAGGCTCTGCTACTCGTTGGCCATTCCAAGAAGCTCTC
241  ---------+---------+---------+---------+---------+---------+  300

TGCTCCCTGAAACCAGAGGATCATGATCACGGTGGCGGCGCCCGAGGTGCAGCAGCCGCA
301  ---------+---------+---------+---------+---------+---------+  360
                        M  I  T  V  A  A  P  E  V  Q  Q  P  Q

GATCGCGGCGGCTGCTGCGGCCGTGGAGGCGGCGGCACCGGAGGCGACGACGATCTTCCG
361  ---------+---------+---------+---------+---------+---------+  420
      I  A  A  A  A  A  V  E  A  A  A  P  E  A  T  T  I  F  R

GTCCAGGCTCCCGGACATCGACATCCCGACCCACATGCCCCTGCACGACTATTGCTTCGC
421  ---------+---------+---------+---------+---------+---------+  480
      S  R  L  P  D  I  D  I  P  T  H  M  P  L  H  D  Y  C  F  A

GACGGCAGCCTCGGCCCCGGACGCGCCGTGCCTCATCACCGCGGCCACGGGGAAGACCTA
481  ---------+---------+---------+---------+---------+---------+  540
      T  A  A  S  A  P  D  A  P  C  L  I  T  A  A  T  G  K  T  Y

CACGTTCGCCGAGACGCACCTGCTGTGCCGCAAGGCCGCGGCGGCGCTGCACGGGCTCGG
541  ---------+---------+---------+---------+---------+---------+  600
      T  F  A  E  T  H  L  L  C  R  K  A  A  A  A  L  H  G  L  G

CGTGCGCCACGGGGACCGGATCATGCTGCTGCTCCAGAACTCCGTGGAGTTCGCGCTCGC
601  ---------+---------+---------+---------+---------+---------+  660
      V  R  H  G  D  R  I  M  L  L  L  Q  N  S  V  E  F  A  L  A

CTTCTTCGGCGCGTCCATGCTCGGCGCCGTCAGCACGGCGGCGAACCCGTTCTGCACGCC
661  ---------+---------+---------+---------+---------+---------+  720
      F  F  G  A  S  M  L  G  A  V  S  T  A  A  N  P  F  C  T  P

GCAGGAGATCCACAAGCAGCTCGTGGCCTCCGGCGCGAAGCTGGTCGTCACGCAGTCCGC
721  ---------+---------+---------+---------+---------+---------+  780
      Q  E  I  H  K  Q  L  V  A  S  G  A  K  L  V  V  T  Q  S  A
```

FIGURE 2

```
      CTACGTCGACAAGCTCCGGCACGAGGCCTTCCCCCGAATCGGCGAGGCCCTCACCGTGAT
781   ---------+---------+---------+---------+---------+---------+   840
       Y  V  D  K  L  R  H  E  A  F  P  R  I  G  E  A  L  T  V  I

CACCATCGACGAGGACGACGGCACCCCGGACGGCTGCCAGCCGTTCTGGGCCCTCGTGTC
841   ---------+---------+---------+---------+---------+---------+   900
       T  I  D  E  D  D  G  T  P  D  G  C  Q  P  F  W  A  L  V  S

AGCCGCCGACGAGAACAGCGTCCCGGAGTCTCCCATCTCGCCGGACGACGCGGTGGCGCT
901   ---------+---------+---------+---------+---------+---------+   960
       A  A  D  E  N  S  V  P  E  S  P  I  S  P  D  D  A  V  A  L

GCCCTACTCGTCGGGCACGACGGGGCTGCCCAAGGGCGTGGTGCTGACGCACGGGGGCT
961   ---------+---------+---------+---------+---------+---------+   1020
       P  Y  S  S  G  T  T  G  L  P  K  G  V  V  L  T  H  G  G  L

GGTGTCGAGCGTGGCGCAGCAGGTGGACGGCGAGAACCCGAACCTGCACATGCGGGCGGG
1021  ---------+---------+---------+---------+---------+---------+   1080
       V  S  S  V  A  Q  Q  V  D  G  E  N  P  N  L  H  M  R  A  G

GGAGGACGTGGTGCTCTGCGTGCTGCCGCTCTTCCACATCTTCTCGCTCAACTCGGTGCT
1081  ---------+---------+---------+---------+---------+---------+   1140
       E  D  V  V  L  C  V  L  P  L  F  H  I  F  S  L  N  S  V  L

GCTGTGCGCGCTGCGGGCGGGCGCCGCCGTGATGCTGATGCCTAGGTTCGAGATGGGGGC
1141  ---------+---------+---------+---------+---------+---------+   1200
       L  C  A  L  R  A  G  A  A  V  M  L  M  P  R  F  E  M  G  A

CATGCTGGAGGGCATCGAGCGGTGGCGCGTCACGGTGGCGGCCGTGGTGCCGCCGCTGGT
1201  ---------+---------+---------+---------+---------+---------+   1260
       M  L  E  G  I  E  R  W  R  V  T  V  A  A  V  V  P  P  L  V

GCTCGCGCTCGCCAAGAACCCCGGGGTGGAGAAGCACGACCTCAGCTCCATTCGGATCGT
1261  ---------+---------+---------+---------+---------+---------+   1320
       L  A  L  A  K  N  P  G  V  E  K  H  D  L  S  S  I  R  I  V

GCTCTCCGGCGCCGCGCCGCTCGGCAAGGAGCTCGAGGACGCGCTACGTGGCCGCCTGCC
1321  ---------+---------+---------+---------+---------+---------+   1380
       L  S  G  A  A  P  L  G  K  E  L  E  D  A  L  R  G  R  L  P

GCAGGCCATCTTCGGACAGGGCTACGGGATGACGGAGGCCGGGCCGGTGCTGTCCATGTG
1381  ---------+---------+---------+---------+---------+---------+   1440
       Q  A  I  F  G  Q  G  Y  G  M  T  E  A  G  P  V  L  S  M  C

CCCGGCGTTCGCGCGGGAGCCGACGCCGGCCAAGTCCGGCTCGTGCGGCACCGTGGTGCG
1441  ---------+---------+---------+---------+---------+---------+   1500
       P  A  F  A  R  E  P  T  P  A  K  S  G  S  C  G  T  V  V  R
```

FIGURE 2 CONTINUED

```
       CAACGCCCAGCTCAAGGTGGTCGACCCCGACACCGGCGTCTCCCTCGGCCGCAACCTCCC
1501   ---------+---------+---------+---------+---------+---------+   1560
        N  A  Q  L  K  V  V  D  P  D  T  G  V  S  L  G  R  N  L  P

CGGCGAGATCTGCATCCGCGGCCCGCAGATCATGAAAGGATACTTGAATGATCCCGTGGC
1561   ---------+---------+---------+---------+---------+---------+   1620
        G  E  I  C  I  R  G  P  Q  I  M  K  G  Y  L  N  D  P  V  A

CACGGCCGCGACCATCGACGTCGAGGGGTGGCTCCACACCGGCGACATCGGCTACGTCGA
1621   ---------+---------+---------+---------+---------+---------+   1680
        T  A  A  T  I  D  V  E  G  W  L  H  T  G  D  I  G  Y  V  D

CGACGACGACGAGGTCTTCATCGTCGACCGCGTCAAGGAGCTCATCAAGTTCAAGGGCTT
1681   ---------+---------+---------+---------+---------+---------+   1740
        D  D  D  E  V  F  I  V  D  R  V  K  E  L  I  K  F  K  G  F

CCAGGTACCGCCGGCCGAGCTCGAGGCTCTGCTCATCGCGCATCCGTCCATCGCCGACGC
1741   ---------+---------+---------+---------+---------+---------+   1800
        Q  V  P  P  A  E  L  E  A  L  L  I  A  H  P  S  I  A  D  A

GGCCGTCGTCCCGCAAAAGGATGATGCCGCCGGCGAGGTCCCGGTTGCCTTCGTGGTCCG
1801   ---------+---------+---------+---------+---------+---------+   1860
        A  V  V  P  Q  K  D  D  A  A  G  E  V  P  V  A  F  V  V  R

CGCCGCCGACTCCGACATCGCCGAGGAGGCCATCAAGGAGTTCGTATCCAAGCAGGTGGT
1861   ---------+---------+---------+---------+---------+---------+   1920
        A  A  D  S  D  I  A  E  E  A  I  K  E  F  V  S  K  Q  V  V

GTTCTACAAGAGGCTGCACAAGGTCTACTTCACCCACGCGATACCCAAGTCGGCGTCGGG
1921   ---------+---------+---------+---------+---------+---------+   1980
        F  Y  K  R  L  H  K  V  Y  F  T  H  A  I  P  K  S  A  S  G

GAAGATACTCAGGAAAGAACTCAGAGCTAAACTCGCCGCCCCGGCCACTGCCTGAAGAGT
1981   ---------+---------+---------+---------+---------+---------+   2040
        K  I  L  R  K  E  L  R  A  K  L  A  A  P  A  T  A  *  R  V

GGTTCATGGCTTCATGCTAATCATTTCGATCAGAAAGGCACTTCTAGCATATATGTTCCA
2041   ---------+---------+---------+---------+---------+---------+   2100
        V  H  G  F  M  L  I  I  S  I  R  K  A  L  L  A  Y  M  F  H

CCTTTTGTTTCATTTGGAAGATTGTATTCCAGCTAGTGGCCAGTGACTGAGTAAGGGATG
2101   ---------+---------+---------+---------+---------+---------+   2160
        L  L  F  H  L  E  D  C  I  P  A  S  G  Q  *

GGGATAAAAGTTTTGTCTACGTTTTCTTTTACGCTACTCTCTCCATTGGGGAGTACAATG
2161   ---------+---------+---------+---------+---------+---------+   2220

TATCAGGGGATTCGTGATTGAAGTTAATCAAGATTGGTTCAATTATAAAAAAAAAAAAA
2221   ---------+---------+---------+---------+---------+---------+   2280

AAAA
2281   ----   2284
```

FIGURE 2 CONTINUED

```
      CGGCACGAGCGCCATTCCTCCACCTTCAGCTCCGGCCAAAGATTTCCATCCGGCGAGATC
  1   ---------+---------+---------+---------+---------+---------+   60

CATGGGCTCCATCGCGGCGGACGCGCCTCCCGCGGAGCTGGTGTTCCGGTCCAAGCTCCC
 61   ---------+---------+---------+---------+---------+---------+  120
       M  G  S  I  A  A  D  A  P  P  A  E  L  V  F  R  S  K  L  P

GGACATCGAGATCCCGACCCACCTGACGCTGCAGGACTACTGCTTCCAGCGCCTGCCGGA
121   ---------+---------+---------+---------+---------+---------+  180
       D  I  E  I  P  T  H  L  T  L  Q  D  Y  C  F  Q  R  L  P  E

GCTCTCCGCGCGCCTGCCTCATCGACGGCGCCACGGGCGCCGCGCTCACCTACGGCGA
181   ---------+---------+---------+---------+---------+---------+  240
       L  S  A  R  A  C  L  I  D  G  A  T  G  A  A  L  T  Y  G  E

GGTGGACGCCCTGTCCCGCCGCTGCGCCGCGGGGCTGCGCCGCCTCGGCGTCGGCAAGGG
241   ---------+---------+---------+---------+---------+---------+  300
       V  D  A  L  S  R  R  C  A  A  G  L  R  R  L  G  V  G  K  G

CGACGTCGTCATGGCGCTCCTCCGCAACTGCCCCGAGTTCGCCTTCGTGTTCCTCGGCGC
301   ---------+---------+---------+---------+---------+---------+  360
       D  V  V  M  A  L  L  R  N  C  P  E  F  A  F  V  F  L  G  A

GGCCCGGCTCGGCGCCGCCACCACCACCGCCAACCCGTTCTACACGCCCCACGAGATCCA
361   ---------+---------+---------+---------+---------+---------+  420
       A  R  L  G  A  A  T  T  T  A  N  P  F  Y  T  P  H  E  I  H

CCGCCAGGCCACCGCCGCCGGGGCCAGGGTCATCGTCACCGAGGCCTGCGCCGTCGAGAA
421   ---------+---------+---------+---------+---------+---------+  480
       R  Q  A  T  A  A  G  A  R  V  I  V  T  E  A  C  A  V  E  K

GGTGCGCGCCTTCGCCGCCGAGAGAGGGATTCCCGTCGTCTCCGTCGACGAGGGCGTCGA
481   ---------+---------+---------+---------+---------+---------+  540
       V  R  A  F  A  A  E  R  G  I  P  V  V  S  V  D  E  G  V  D

CGGCGGCTGCCTCCCGTTCGCCGAGACTCTGCTCGGGGAAGAAAGCGGGGAGCGGTTCGT
541   ---------+---------+---------+---------+---------+---------+  600
       G  G  C  L  P  F  A  E  T  L  L  G  E  E  S  G  E  R  F  V

CGACGAGGCGGTCGACCCCGACGACGTGGTGGCGCTGCCGTACTCGTCCGGCACCACCGG
601   ---------+---------+---------+---------+---------+---------+  660
       D  E  A  V  D  P  D  D  V  V  A  L  P  Y  S  S  G  T  T  G

CCTGCCCAAGGGCGTCATGCTCACCCACCGCAGCCTCGTCACCAGCGTCGCCCAGCAGGT
661   ---------+---------+---------+---------+---------+---------+  720
       L  P  K  G  V  M  L  T  H  R  S  L  V  T  S  V  A  Q  Q  V

GGACGGTGAGAACCCGAACCTGCACTTCAGCTCGTCGGACGTGCTGCTGTGCGTGCTGCC
721   ---------+---------+---------+---------+---------+---------+  780
       D  G  E  N  P  N  L  H  F  S  S  S  D  V  L  L  C  V  L  P
```

FIGURE 3

```
       GCTGTTCCACATCTACTCGCTCAACTCGGTGCTGCTCGCCGGTCTCCGCGCCGGGTGCGC
781    ---------+---------+---------+---------+---------+---------+    840
         L  F  H  I  Y  S  L  N  S  V  L  L  A  G  L  R  A  G  C  A

GATCGTGATCATGCGCAAGTTCGACCACGGCGCGCTGGTGGACCTGGTGCGCACGCACGG
841    ---------+---------+---------+---------+---------+---------+    900
          I  V  I  M  R  K  F  D  H  G  A  L  V  D  L  V  R  T  H  G

CGTCACCGTGGCGCCATTCGTGCCGCCCATCGTGGTGGAGATCGCCAAGAGCGCGCGGGT
901    ---------+---------+---------+---------+---------+---------+    960
          V  T  V  A  P  F  V  P  P  I  V  V  E  I  A  K  S  A  R  V

GACCGCCGCGGACCTGGCGTCCATCCGGCTGGTCATGTCGGGGGCGGCGCCCATGGGCAA
961    ---------+---------+---------+---------+---------+---------+    1020
          T  A  A  D  L  A  S  I  R  L  V  M  S  G  A  A  P  M  G  K

GGAGCTGCAGGACGCGTTCATGGCCAAGATCCCCAACGCCGTGCTCGGCCAGGGATATGG
1021   ---------+---------+---------+---------+---------+---------+    1080
          E  L  Q  D  A  F  M  A  K  I  P  N  A  V  L  G  Q  G  Y  G

GATGACCGAGGCCGGCCCTGTGCTGGCGATGTGCCTGGCCTTCGCCAAGGAGCCGTTCGC
1081   ---------+---------+---------+---------+---------+---------+    1140
          M  T  E  A  G  P  V  L  A  M  C  L  A  F  A  K  E  P  F  A

GGTCAAGTCCGGTTCCTGCGGCACCGTCGTCAGGAACGCCGAGCTCAAGATCGTCGACCC
1141   ---------+---------+---------+---------+---------+---------+    1200
          V  K  S  G  S  C  G  T  V  V  R  N  A  E  L  K  I  V  D  P

CGACACCGGCGCCTCCCTCGGCCGCAACCTGCCGGGGGAGATCTGCATCCGCGGCAAGCA
1201   ---------+---------+---------+---------+---------+---------+    1260
          D  T  G  A  S  L  G  R  N  L  P  G  E  I  C  I  R  G  K  Q

GATCATGAAAGGTTACCTAAATGATCCGGTGGCCACAAAGAACACCATTGACAAGGACGG
1261   ---------+---------+---------+---------+---------+---------+    1320
          I  M  K  G  Y  L  N  D  P  V  A  T  K  N  T  I  D  K  D  G

TTGGCTGCATACTGGTGACATTGGTTATGTCGATGATGACGACGAGATCTTTATTGTCGA
1321   ---------+---------+---------+---------+---------+---------+    1380
          W  L  H  T  G  D  I  G  Y  V  D  D  D  D  E  I  F  I  V  D

CAGACTGAAGGAGATAATTAAATATAAGGGATTCCAAGTACCTCCGGCGGAACTTGAAGC
1381   ---------+---------+---------+---------+---------+---------+    1440
          R  L  K  E  I  I  K  Y  K  G  F  Q  V  P  P  A  E  L  E  A

CCTTCTCATTACACACCCTGAAATCAAGGATGCTGCTGTCGTATCGATGCAAGACGAACT
1441   ---------+---------+---------+---------+---------+---------+    1500
          L  L  I  T  H  P  E  I  K  D  A  A  V  V  S  M  Q  D  E  L

TGCTGGTGAAGTTCCGGTTGCGTTTGTTGTGCGGACTGAGGGTTCAGAGATCAGCGAAAA
1501   ---------+---------+---------+---------+---------+---------+    1560
          A  G  E  V  P  V  A  F  V  V  R  T  E  G  S  E  I  S  E  N
```

FIGURE 3 CONTINUED

```
      CGAGATCAAGCAGTTCGTTGCAAAAGAGGTTGTTTTCTACAAGAGGATCTGCAAAGTGTT
1561  ---------+---------+---------+---------+---------+---------+  1620
        E  I  K  Q  F  V  A  K  E  V  V  F  Y  K  R  I  C  K  V  F

CTTCGCGGATTCCATTCCAAAGAGTCCATCTGGCAAGATCCTCAGGAAGGACCTGAGAGC
1621  ---------+---------+---------+---------+---------+---------+  1680
        F  A  D  S  I  P  K  S  P  S  G  K  I  L  R  K  D  L  R  A

AAAGCTCGCCGCAGGCATTCCCAGCAGTAATACCACACAGTCCAAAAGCTAAGTCAGATA
1681  ---------+---------+---------+---------+---------+---------+  1740
        K  L  A  A  G  I  P  S  S  N  T  T  Q  S  K  S  *

TATTGTTTCCCAACCTTACACACCTCTGTCCAACACCATGTAATGTTCTTAATATAAACG
1741  ---------+---------+---------+---------+---------+---------+  1800

GAAATTATTACATATAGAAGGGCTGATTCTTTTTACTAGATGTGTCCAACATATGATATG
1801  ---------+---------+---------+---------+---------+---------+  1860

CTTGTTAGGCCGATGATGTGTAACCTGTCATGTATAGATACCGCCTTTTTTTGACAAGAA
1861  ---------+---------+---------+---------+---------+---------+  1920

AGGCTGATTATAATGTATACCGTGAACTGAATATTTGTTCAGGGAGATCAAAAAAAAAAA
1921  ---------+---------+---------+---------+---------+---------+  1980

AAAAAAAAAAAA
1981  ---------+--  1992
```

FIGURE 3 CONTINUED

```
     CGGCACGAGATCTCCCACGACTAATTTAGAAGAAGATTTACTTAGTCTCTGCTTCTCGCT
  1  ---------+---------+---------+---------+---------+---------+   60

CGATCGCCGGCCGGTGAGGTAGCTAGCTAGCTACTCGTACTAGACCATTACCATGGGTTC
 61  ---------+---------+---------+---------+---------+---------+  120
                                                          M  G  S

CGTGCCGGAGGAGTCAGTGGTGGCGGTGGCACCGGCGGAGACGGTGTTCCGGTCGAAGCT
121  ---------+---------+---------+---------+---------+---------+  180
      V  P  E  E  S  V  V  A  V  A  P  A  E  T  V  F  R  S  K  L

CCCCGACATCGAGATCAACAACGAGCAGACGCTGCAGAGCTACTGCTTCGAGAAGATGGC
181  ---------+---------+---------+---------+---------+---------+  240
      P  D  I  E  I  N  N  E  Q  T  L  Q  S  Y  C  F  E  K  M  A

CGAGGTCGCGTCCCGCCCCTGCATCATCGACGGCCAGACGGGCGCCTCCTACACCTACAC
241  ---------+---------+---------+---------+---------+---------+  300
      E  V  A  S  R  P  C  I  I  D  G  Q  T  G  A  S  Y  T  Y  T

GGAGGTCGACTCCCTGACCCGTCGCGCCGCGGCGGGGCTGCGCCGCATGGGCGTGGGGAA
301  ---------+---------+---------+---------+---------+---------+  360
      E  V  D  S  L  T  R  R  A  A  A  G  L  R  R  M  G  V  G  K

GGGCGACGTGGTGATGAACCTGCTGCGCAACTGCCCGGAGTTCGCCTTCTCCTTCCTGGG
361  ---------+---------+---------+---------+---------+---------+  420
      G  D  V  V  M  N  L  L  R  N  C  P  E  F  A  F  S  F  L  G

CGCGGCGCGGCTGGGCGCCGCCACCACCACCGCCAACCCGTTCTACACCCCGCACGAGAT
421  ---------+---------+---------+---------+---------+---------+  480
      A  A  R  L  G  A  A  T  T  T  A  N  P  F  Y  T  P  H  E  I

CCACCGCCAGGCGGAGGCGGCGGGCGCCAAGCTGATCGTGACCGAGGCCTGCGCCGTGGA
481  ---------+---------+---------+---------+---------+---------+  540
      H  R  Q  A  E  A  A  G  A  K  L  I  V  T  E  A  C  A  V  E

GAAGGTGCTGGAGTTCGCGGCGGGCGGGGCGTGCCCGTGGTCACCGTCGACGGGAGGCG
541  ---------+---------+---------+---------+---------+---------+  600
      K  V  L  E  F  A  A  G  R  G  V  P  V  V  T  V  D  G  R  R

CGACGGGTGCGTGGACTTCGCGGAGCTGATCGCCGGCGAGGAGCTGCCCGAGGCGGACGA
601  ---------+---------+---------+---------+---------+---------+  660
      D  G  C  V  D  F  A  E  L  I  A  G  E  E  L  P  E  A  D  E

GGCCGGGGTCCTCCCCGACGACGTCGTCGCCCTGCCCTACTCCTCCGGCACCACCGGGCT
661  ---------+---------+---------+---------+---------+---------+  720
      A  G  V  L  P  D  D  V  V  A  L  P  Y  S  S  G  T  T  G  L

CCCCAAGGGCGTCATGCTCACCCACCGCAGCCTCGTCACCAGCGTCGCCCAGCTGGTCGA
721  ---------+---------+---------+---------+---------+---------+  780
      P  K  G  V  M  L  T  H  R  S  L  V  T  S  V  A  Q  L  V  D
```

FIGURE 4

```
              CGGGTCGAACCCTAACGTGTGCTTCAACAAGGACGACGCGCTGCTGTGCCTGCTGCCGCT
    781       ---------+---------+---------+---------+---------+---------+      840
                G  S  N  P  N  V  C  F  N  K  D  D  A  L  L  C  L  L  P  L

CTTCCACATCTACTCGCTGCACACGGTGCTGCTGGCGGGGCTCCGCGTCGGCGCCGCCAT
    841       ---------+---------+---------+---------+---------+---------+      900
                F  H  I  Y  S  L  H  T  V  L  L  A  G  L  R  V  G  A  A  I

CGTCATCATGCGCAAGTTCGACGTCGGCGCGCTGGTGGACCTCGTCCGCGCGCACCGCAT
    901       ---------+---------+---------+---------+---------+---------+      960
                V  I  M  R  K  F  D  V  G  A  L  V  D  L  V  R  A  H  R  I

CACCATCGCGCCATTCGTGCCGCCCATCGTCGTGGAGATCGCCAAGAGCGACCGCGTCGG
    961       ---------+---------+---------+---------+---------+---------+     1020
                T  I  A  P  F  V  P  P  I  V  V  E  I  A  K  S  D  R  V  G

CGCCGACGACCTCGCATCCATCCGCATGGTGCTCTCCGGCGCCGCGCCCATGGGCAAGGA
   1021       ---------+---------+---------+---------+---------+---------+     1080
                A  D  D  L  A  S  I  R  M  V  L  S  G  A  A  P  M  G  K  D

CCTCCAGGACGCCTTCATGGCCAAGATCCCCAACGCCGTGCTCGGACAGGGGTACGGGAT
   1081       ---------+---------+---------+---------+---------+---------+     1140
                L  Q  D  A  F  M  A  K  I  P  N  A  V  L  G  Q  G  Y  G  M

GACCGAGGCTGGGCCGGTGCTGGCCATGTGCCTGGCGTTCGCCAAGGAGCCGTTCAAGGT
   1141       ---------+---------+---------+---------+---------+---------+     1200
                T  E  A  G  P  V  L  A  M  C  L  A  F  A  K  E  P  F  K  V

CAAGTCCGGGTCGTGCGGAACCGTGGTGCGCAACGCCGAGCTCAAGGTCGTCGACCCCGA
   1201       ---------+---------+---------+---------+---------+---------+     1260
                K  S  G  S  C  G  T  V  V  R  N  A  E  L  K  V  V  D  P  D

CACCGGCGCATCCCTCGGCCGGAACCAGCCTGGCGAGATTTGCGTCCGGGGGAAGCAGAT
   1261       ---------+---------+---------+---------+---------+---------+     1320
                T  G  A  S  L  G  R  N  Q  P  G  E  I  C  V  R  G  K  Q  I

CATGATAGGTTACCTGAACGACCCAGAGTCGACCAAGAACACCATCGACAAGGACGGCTG
   1321       ---------+---------+---------+---------+---------+---------+     1380
                M  I  G  Y  L  N  D  P  E  S  T  K  N  T  I  D  K  D  G  W

GCTGCACACCGGAGACATCGGCTTGGTGGATGACGACGACGAGATCTTCATCGTCGACAG
   1381       ---------+---------+---------+---------+---------+---------+     1440
                L  H  T  G  D  I  G  L  V  D  D  D  D  E  I  F  I  V  D  R

GCTCAAGGAGATCATCAAGTACAAGGGCTTCCAAGTGGCGCCGGCGGAGCTCGAGGCCCT
   1441       ---------+---------+---------+---------+---------+---------+     1500
                L  K  E  I  I  K  Y  K  G  F  Q  V  A  P  A  E  L  E  A  L

CCTCCTCACGAACCCGGAGGTCAAGGACGCCGCCGTCGTAGGGGTGAAGGATGATCTCTG
   1501       ---------+---------+---------+---------+---------+---------+     1560
                L  L  T  N  P  E  V  K  D  A  A  V  V  G  V  K  D  D  L  C
```

FIGURE 4 CONTINUED

```
             CGGCGAAGTCCCGGTCGCCTTCATTAAGAGGATCGAAGGATCTGAGATCAACGAGAACGA
     1561    ---------+---------+---------+---------+---------+---------+    1620
               G  E  V  P  V  A  F  I  K  R  I  E  G  S  E  I  N  E  N  E

GATCAAGCAATTCGTCTCAAAGGAGGTTGTTTTCTACAAGAGGATCAACAAGGTCTACTT
     1621    ---------+---------+---------+---------+---------+---------+    1680
               I  K  Q  F  V  S  K  E  V  V  F  Y  K  R  I  N  K  V  Y  F

CACCGACTCCATTCCCAAGAACCCTTCCGGCAAGATCCTAAGGAAGGACTTGAGAGCCAG
     1681    ---------+---------+---------+---------+---------+---------+    1740
               T  D  S  I  P  K  N  P  S  G  K  I  L  R  K  D  L  R  A  R

GCTCGCCGCTGGCATCCCCACCGAAGTTGCCGCGCCGAGAAGCTAAGGGCCGCTTCTCAG
     1741    ---------+---------+---------+---------+---------+---------+    1800
               L  A  A  G  I  P  T  E  V  A  A  P  R  S  *

GAACGCAGTCACCCATGGTGCTGTTTAGGTGCTGTTATAGACCACACCAAATGGGGAAAG
     1801    ---------+---------+---------+---------+---------+---------+    1860

AAACTACGGGAGGGGATCATATTATTGTTGCAGGAGATATCAGTTTGTTGATTCGCCCTG
     1861    ---------+---------+---------+---------+---------+---------+    1920

CTTGTGTAATGTTGATAAAATGAAATGATATAATAGATGTGTTGTTTTATTTTTTGACCA
     1921    ---------+---------+---------+---------+---------+---------+    1980

TGTAAGAACAAGGCTGTTTTATACACTACTTATTTTTTGAAAAAAAAAAAAAAAAAAA
     1981    ---------+---------+---------+---------+---------+---------     2038
```

FIGURE 4 CONTINUED

```
                10         20         30         40         50         60
Lp4CL1   MITVAAPEVQQPQIAAAAAAVEAAAPEATTIFRSRLPDIDIPTHMPLHDYCFATAASAPD
Lp4CL2                  MGSIAADAPPAEL..VFRSKLPDIEIPTHLTLQDYCFQRLPELSA
Lp4CL3              MGSVPEESVVAVAPAETVFRSKLPDIEINNEQTLQSYCFEKMAEVAS 70         80         90        100        110        120
Lp4CL1   APCLITAATGKTYTFAETHLLCRKAAAALHGLGVRHGDRIMLLLQNSVEEFALAFFGASML
Lp4CL2   RACLIDGATGAALTYGEVDALSRRCAAGLRRLGVGKGDVVMALLRNCPEEFAFVFLGAARL
Lp4CL3   RPCIIDGQTGASYTYTEVDSLTRRAAAGLRRMGVGKGDVVMNLLRNCPEEFAFSFLGAARL 130        140        150        160        170        180
Lp4CL1   GAVSTAANPFCTPQEIHKQLVASGAKLVVTQSAYVDKLRHEAFPRIGEALTVITIDEDDG
Lp4CL2   GAATTTANPFYTPHEIHRQATAAGARVIVTEACAVEKVRAFAAERGIPVVSV......DE
Lp4CL3   GAATTTANPFYTPHEIHRQAEAAGAKLIVTEACAVEKVLEFAAGRGVPVVTV......DG 190        200        210        220        230        240
Lp4CL1   TPDGCQPFWALVSAADENSVPESPIS..PDDAVALPYSSGTTGLPKGVVLTHGGLVSSVA
Lp4CL2   GVDGGCLPFAETLLGEESGERFVDEAVDPDDVVALPYSSGTTGLPKGVMLTHRSLVTSVA
Lp4CL3   RRDGCVDF.AELIAGEELPEADEAGVL.PDDVVALPYSSGTTGLPKGVMLTHRSLVTSVA 250        260        270        280        290        300
Lp4CL1   QQVDGENPNLHMRAGEDVVLCVLPLFHIFSLNSVLLCALRAGAAVMLMPRFEMGAMLEGI
Lp4CL2   QQVDGENPNLHFSS.SDVLLCVLPLFHIYSLNSVLLAGLRAGCAIVIMRKFDHGALVDLV
Lp4CL3   QLVDGSNPNVCFNK.DDALLCLLPLFHIYSLHTVLLAGLRVGAAIVIMRKFDVGALVDLV 310        320        330        340        350        360
Lp4CL1   ERWRVTVAAVVPPLVLALAKNPGVEKHDLSSIRIVLSGAAPLGKELEDALRGRLPQAIFG
Lp4CL2   RTHGVTVAPFVPPIVVEIAKSARVTAADLASIRLVMSGAAPMGKELQDAFMAKIPNAVLG
Lp4CL3   RAHRITIAPFVPPIVVEIAKSDRVGADDLASIRMVLSGAAPMGKDLQDAFMAKIPNAVLG 370        380        390        400        410        420
Lp4CL1   QGYGMTEAGPVLSMCPAFAREPTPAKSGSCGTVVRNAQLKVVDPDTGVSLGRNLPGEICI
Lp4CL2   QGYGMTEAGPVLAMCLAFAKEPFAVKSGSCGTVVRNAELKIVDPDTGASLGRNLPGEICI
Lp4CL3   QGYGMTEAGPVLAMCLAFAKEPFKVKSGSCGTVVRNAELKVVDPDTGASLGRNQPGEICV 430        440        450        460        470        480
Lp4CL1   RGPQIMKGYLNDPVATAATIDVEGWLHTGDIGYVDDDEVFIVDRVKELIKFKGFQVPPA
Lp4CL2   RGKQIMKGYLNDPVATKNTIDKDGWLHTGDIGYVDDDEIFIVDRLKETIKYKGFQVPPA
Lp4CL3   RGKQIMLGYLNDPESTKNTIDKDGWLHTGDIGLVDDDEIFIVDRLKEIIKYKGFQVAPA 490        500        510        520        530        540
Lp4CL1   ELEALLIAHPSIADAAVVPQKDDAAGEVPVAFVVRAADSDTAEEAIKEFVSKQVVFYKRL
Lp4CL2   ELEALLITHPEIKDAAVVSMQDELAGEVPVAFVVRTEGSEISENEIKQFVAKEVVFYKRI
Lp4CL3   ELEALLLTNPEVKDAAVVGVKDDLCGEVPVAFIKRIEGSEINENEIKQFVSKEVVFYKRI 550        560        570
Lp4CL1   HKVYFTHAIPKSASGKILRKELRAKLAAPATA
Lp4CL2   CKVFFADSIPKSPSGKILRKDLRAKLAAGIPSSNTTQSKS
Lp4CL3   NKVYFTDSIPKNPSGKILRKDLRARLAAGIPTEVAAPRS
```

FIGURE 5

```
      GGCACGAGGAATCCTACCAAACCGAGCTACCAGATCCTTCTCTACTAATCGAGCTCCCTA
   1  ---------+---------+---------+---------+---------+---------+   60

CGCTGCTCCGCCTGTCTTCGTTTCCGCCTCACCGCCGGCCGGTTCTCCGCTCCAAGCTAC
  61  ---------+---------+---------+---------+---------+---------+  120

GTCCGTCCGTCCACATATATAGCATCGACATGACCATCGCCGAGGTCGTGGCTGCCGGAG
 121  ---------+---------+---------+---------+---------+---------+  180
                                     M  T  I  A  E  V  V  A  A  G  D

ACACCGCCGCCGCGGTGGTGCAGCCCGCCGGGAACGGGCAGACCGTGTGCGTGACCGGCG
 181  ---------+---------+---------+---------+---------+---------+  240
       T  A  A  A  V  V  Q  P  A  G  N  G  Q  T  V  C  V  T  G  A

CCGCCGGGTACATCGCGTCGTGGCTCGTCAAGCTGCTGCTGGAGAAGGGGTACACCGTCA
 241  ---------+---------+---------+---------+---------+---------+  300
        A  G  Y  I  A  S  W  L  V  K  L  L  L  E  K  G  Y  T  V  K

AGGGCACCGTCAGGAACCCAGACGACCCGAAGAACGCGCACCTGAGGGCGCTCGACGGCG
 301  ---------+---------+---------+---------+---------+---------+  360
         G  T  V  R  N  P  D  D  P  K  N  A  H  L  R  A  L  D  G  A

CCGCCGACCGGCTGGTCCTCTGCAAGGCCGACCTCCTCGACTACGACGCCATCCGCCGCG
 361  ---------+---------+---------+---------+---------+---------+  420
         A  D  R  L  V  L  C  K  A  D  L  L  D  Y  D  A  I  R  R  A

CCATCGACGGCTGCCACGGCGTCTTCCACACCGCGTCCCCCGTCACCGACGACCCCGAGC
 421  ---------+---------+---------+---------+---------+---------+  480
         I  D  G  C  H  G  V  F  H  T  A  S  P  V  T  D  D  P  E  Q

AAATGGTGGAGCCGGCGGTGAGGGGCACGCAGTACGTCATAGACGCGGCGGCGGAGGCCG
 481  ---------+---------+---------+---------+---------+---------+  540
         M  V  E  P  A  V  R  G  T  Q  Y  V  I  D  A  A  A  E  A  G

GCACGGTGCGGCGGATGGTGCTCACCTCCTCCATCGGCGCCGTCACCATGGACCCCAACC
 541  ---------+---------+---------+---------+---------+---------+  600
         T  V  R  R  M  V  L  T  S  S  I  G  A  V  T  M  D  P  N  R

GCGGGCCGGACGTGGTCGTCGACGAGTCGTGCTGGAGCGACCTCGACTTCTGCAAGAAAA
 601  ---------+---------+---------+---------+---------+---------+  660
         G  P  D  V  V  V  D  E  S  C  W  S  D  L  D  F  C  K  K  T

CCAGGAACTGGTACTGCTACGGGAAGGCGGTTGCGGAGCAGGCGGCATCGGAGTTGGCGC
 661  ---------+---------+---------+---------+---------+---------+  720
         R  N  W  Y  C  Y  G  K  A  V  A  E  Q  A  A  S  E  L  A  R

GGCAGCGCGGCGTGGACCTTGTGGTGGTGAACCCGGTGCTGGTGATCGGCCCCCTGCTGC
 721  ---------+---------+---------+---------+---------+---------+  780
         Q  R  G  V  D  L  V  V  V  N  P  V  L  V  I  G  P  L  L  Q
```

FIGURE 10

```
        AGCCGACGGTGAACGCCAGCATCGGCCACATCCTCAAGTACCTGGACGGGTCGGCCAGCA
781     ---------+---------+---------+---------+---------+---------+   840
          P  T  V  N  A  S  I  G  H  I  L  K  Y  L  D  G  S  A  S  K

AGTTCGCCAACGCCGTGCAGGCGTACGTGGACGTCCGCGACGTGGCCGACGCCCACCTCC
841     ---------+---------+---------+---------+---------+---------+   900
          F  A  N  A  V  Q  A  Y  V  D  V  R  D  V  A  D  A  H  L  R

GCGTCTTCGAGTGCGCCGCCGCGTCCGGCCGCCACCTCTGCGCCGAGCGCGTCCTCCACC
901     ---------+---------+---------+---------+---------+---------+   960
          V  F  E  C  A  A  A  S  G  R  H  L  C  A  E  R  V  L  H  R

GCGAGGACGTCGTGCGCATCCTCGCCAAGCTCTTCCCCGAGTACCCCGTCCCCACCAGGT
961     ---------+---------+---------+---------+---------+---------+   1020
          E  D  V  V  R  I  L  A  K  L  F  P  E  Y  P  V  P  T  R  C

GCTCTGATGAGACGAACCCGAGGAAGCAGCCATACAAGATGTCGAACCAGAAGCTCCAGG
1021    ---------+---------+---------+---------+---------+---------+   1080
           S  D  E  T  N  P  R  K  Q  P  Y  K  M  S  N  Q  K  L  Q  D

ACCTCGGACTCGAGTTCAGGCCGGTGAGCCAGTCCCTGTACGAGACGGTGAAGAGCCTCC
1081    ---------+---------+---------+---------+---------+---------+   1140
          L  G  L  E  F  R  P  V  S  Q  S  L  Y  E  T  V  K  S  L  Q

AGGAGAAGGGCCACCTTCCGGTGCTCAGCGAGCAGGCAGAGGCGGACAAGGAAACCCTAG
1141    ---------+---------+---------+---------+---------+---------+   1200
          E  K  G  H  L  P  V  L  S  E  Q  A  E  A  D  K  E  T  L  A

CTGCCGAGCTGCAGGCAGGGGTTACCATCCGAGCATGAGGAACAAGAAATCAACCATGTC
1201    ---------+---------+---------+---------+---------+---------+   1260
           A  E  L  Q  A  G  V  T  I  R  A  *

CATACTGCTACTGTCATGTAAACCAGCTGTTGAATGCCTAAAATCTAAGTTCTTGTAATA
1261    ---------+---------+---------+---------+---------+---------+   1320

CTGTGTTGTTTCATGTGGACTAGATTGATCGAATAAACATCTCTACACAAGGTTGCTAAA
1321    ---------+---------+---------+---------+---------+---------+   1380

AAAAAAAAAAAAAAA
1381    ---------+-----   1395
```

FIGURE 10 CONTINUED

```
     GGCACGAGCAACAAGTCATCAATGGCGGAAGGCTTGCCGGCGCTCGGTTGGGCTGCGAGG
  1  ---------+---------+---------+---------+---------+---------+   60
                        M  A  E  G  L  P  A  L  G  W  A  A  R

GACGCCTCCGGTCACCTCTCCCCTTACAGCTTCTCGAGAAGCGTTCCGAAGGACGACgAT
 61  ---------+---------+---------+---------+---------+---------+  120
      D  A  S  G  H  L  S  P  Y  S  F  S  R  S  V  P  K  D  D  D

GTGACGATCAAGGTGCTCTTCTGCGGGATCTGCCACACTGACCTCCACATCATCAAGAAC
121  ---------+---------+---------+---------+---------+---------+  180
      V  T  I  K  V  L  F  C  G  I  C  H  T  D  L  H  I  I  K  N

GACTGGGGCAACGCCCTCTACCCCATCGTCCCAGGGCATGAGATCGTGGGCGTCGTCGCC
181  ---------+---------+---------+---------+---------+---------+  240
      D  W  G  N  A  L  Y  P  I  V  P  G  H  E  I  V  G  V  V  A

AGCGTCGGCAGCGGCGTCAGCAGCTTCAAGGCCGGCgACACGGTGGGCGTGGGCTACTTC
241  ---------+---------+---------+---------+---------+---------+  300
      S  V  G  S  G  V  S  S  F  K  A  G  D  T  V  G  V  G  Y  F

CTCGACTCCTGCCGCACCTGCTACAGCTGCAGCAAGGGGTACGAGAACTTCTGCCCCACC
301  ---------+---------+---------+---------+---------+---------+  360
      L  D  S  C  R  T  C  Y  S  C  S  K  G  Y  E  N  F  C  P  T

CTGACGCTCACCTCCAACGGCGTCGACGGCGGCGGCGCCACCACCCAGGGCGGCTTCTCC
361  ---------+---------+---------+---------+---------+---------+  420
      L  T  L  T  S  N  G  V  D  G  G  G  A  T  T  Q  G  G  F  S

GACGTCCTCGTCGTCAACAAGGACTACGTCATCCGCGTCCCGGACAACCTGCCCCTGGCC
421  ---------+---------+---------+---------+---------+---------+  480
      D  V  L  V  V  N  K  D  Y  V  I  R  V  P  D  N  L  P  L  A

GGCGCGGCACCTCTCCTCTGCGCCGGCGTCACAGTCTACAGCCCTATGGTGGAGTACGGC
481  ---------+---------+---------+---------+---------+---------+  540
      G  A  A  P  L  L  C  A  G  V  T  V  Y  S  P  M  V  E  Y  G

CTCAACGCCCCcgGGAAGCACyTCGGcGTCGTCGGCCTGGGCGGGCTCGGCCACGTCGcC
541  ---------+---------+---------+---------+---------+---------+  600
      L  N  A  P  G  K  H  X  G  V  V  G  L  G  G  L  G  H  V  A

GTCAAGTTCGGCAAGGCCTTCGGGATGACCGTCACCGTCATCAGCTCCTCGGACAGGAAG
601  ---------+---------+---------+---------+---------+---------+  660
      V  K  F  G  K  A  F  G  M  T  V  T  V  I  S  S  S  D  R  K

CGCGACGAGGCGCTCGGCCGCCTCGGCGCCGACGCcTTCCTCGTCAGCAGCGACCCCGAG
661  ---------+---------+---------+---------+---------+---------+  720
      R  D  E  A  L  G  R  L  G  A  D  A  F  L  V  S  S  D  P  E
```

FIGURE 13

```
     CAGATGAAGGCGGCGGCGGGCACCATGGACGGCATCATCGACACGGTGTCCGCGGGCCAC
721  ---------+---------+---------+---------+---------+---------+  780
     Q  M  K  A  A  A  G  T  M  D  G  I  I  D  T  V  S  A  G  H

CCGATCGTGCCGCTGCTCGACCTGCTCAAGCCCATGGGGCAGATGGTCGTGGTGGGCGCG
781  ---------+---------+---------+---------+---------+---------+  840
     P  I  V  P  L  L  D  L  L  K  P  M  G  Q  M  V  V  V  G  A

CCCAGCAAGCCGCTCGAGCTCCCGGCCTTCGCCATCATCGGCGGCGGCAAGCGCCTCGCC
841  ---------+---------+---------+---------+---------+---------+  900
     P  S  K  P  L  E  L  P  A  F  A  I  I  G  G  G  K  R  L  A

GGGAGCGGCACCGGCAGCGTCGCACACTGCCagGCCATGCTCGACTTCGCGGGCAAGCAC
901  ---------+---------+---------+---------+---------+---------+  960
     G  S  G  T  G  S  V  A  H  C  Q  A  M  L  D  F  A  G  K  H

GGCATCACCGCCGACGTCGAGGTCGTCAAGATGGACTACgGTCAACACCGCCATCGAGCG
961  ---------+---------+---------+---------+---------+---------+  1020
     G  I  T  A  D  V  E  V  V  K  M  D  Y  G  Q  H  R  H  R  A

GCTAGAGAAGAACGACGTCAGGTACCGCTTCGTCATCGACGTCGCCGGCAGCCACCTGCA
1021 ---------+---------+---------+---------+---------+---------+  1080
     A  R  E  E  R  R  Q  V  P  L  R  H  R  R  R  Q  P  P  A

GGGCACCGCCGCTTAACTTGTGCTACACAATGTGGACGCGCGCTCGTTTGGTCCAGAAAA
1081 ---------+---------+---------+---------+---------+---------+  1140
     G  H  R  R  L  T  C  A  T  Q  C  G  R  A  L  V  W  S  R  K

AGGTTCGCCGGCTCACAGCCACATGAACAAGTCAATGAGTCGTTGGTGTGTTGTTTATCT
1141 ---------+---------+---------+---------+---------+---------+  1200
     R  F  A  G  S  Q  P  H  E  Q  V  N  E  S  L  V  C  C  L  S

TCATTCCACATATGGGACGCAGTTCCAGATTTTCATGTCAAATAATTGCGTCGTGTGCGG
1201 ---------+---------+---------+---------+---------+---------+  1260
     S  F  H  I  W  D  A  V  P  D  F  H  V  K

TTGTCAAGACTCAAATAGGAGAAAAAAAGACTCGTGATTTCGTTTTGCAAAAAAAAAAAA
1261 ---------+---------+---------+---------+---------+---------+  1320

AAAAA
1321 -----  1325
```

FIGURE 13 CONTINUED

```
     GGCACGAGTCGCCTCCAACGTCTTCCCTTAACCGGCCGTCCCTACGCtTGCACCACCACC
  1  ---------+---------+---------+---------+---------+---------+   60

ACGCACAGACAGAGCAGTTTCCCAGCCCCGCCGGAACCGGATGGCACCCACGGCGGCGG
 61  ---------+---------+---------+---------+---------+---------+  120
                                              M   A   P   T   A   A   E

AGCAGACGGAGCACCACCAGCACACCAGGAAGGCGGTGGGGCTGGCGGCGCGCGACGACG
121  ---------+---------+---------+---------+---------+---------+  180
      Q   T   E   H   H   Q   H   T   R   K   A   V   G   L   A   A   R   D   D   A

CCGGCCACCTCTCCCCGCTCGCCATCACACGGAGGAGCACAGGAGACGACGATGTGGTGA
181  ---------+---------+---------+---------+---------+---------+  240
      G   H   L   S   P   L   A   I   T   R   R   S   T   G   D   D   D   V   V   I

TAAAGATTTTGTACTGCGGAATCTGCCACTCTGACCTGCACGCCCTGAAGAACGACTGGA
241  ---------+---------+---------+---------+---------+---------+  300
      K   I   L   Y   C   G   I   C   H   S   D   L   H   A   L   K   N   D   W   K

AGAACTCAAGGTACCCGATGATCCCCGGGCACGAGATCGCCGGCGAGGTCACGGAGGTGG
301  ---------+---------+---------+---------+---------+---------+  360
      N   S   R   Y   P   M   I   P   G   H   E   I   A   G   E   V   T   E   V   G

GCAAGAACGTGAGCAAGTTCAAGGCCGGCGACCGCGTGGGCGTCGGGTGCATGGTGAACT
361  ---------+---------+---------+---------+---------+---------+  420
      K   N   V   S   K   F   K   A   G   D   R   V   G   V   G   C   M   V   N   S

CGTGCCGGTCGTGCGAGAGCTGCGACAAGGGCTTCGAGAACCACTGCCCGGGCATGATCC
421  ---------+---------+---------+---------+---------+---------+  480
      C   R   S   C   E   S   C   D   K   G   F   E   N   H   C   P   G   M   I   L

TCACCTACAACTCGGTCGACGTCGACGGCACCGTCACCTACGGCGGCTACTCCAGCATGG
481  ---------+---------+---------+---------+---------+---------+  540
      T   Y   N   S   V   D   V   D   G   T   V   T   Y   G   G   Y   S   S   M   V

TGGTGGTGCACGAGCGGTTCGTGGTCCGGTTCCCCGACGCCATGCCGCTGGACAAGGGCG
541  ---------+---------+---------+---------+---------+---------+  600
      V   V   H   E   R   F   V   V   R   F   P   D   A   M   P   L   D   K   G   A

CGCCGCTGCTGTGCGCCGGCATCACCGTGTACAGCCCCATGAAGTACCACGGGCTCAACG
601  ---------+---------+---------+---------+---------+---------+  660
      P   L   L   C   A   G   I   T   V   Y   S   P   M   K   Y   H   G   L   N   V

TTCCCGGGCTGCACCTCGGCGTGCTGGGGCTGGGCGGGCTGGGCCACGTTGCGGTCAAGT
661  ---------+---------+---------+---------+---------+---------+  720
      P   G   L   H   L   G   V   L   G   L   G   G   L   G   H   V   A   V   K   F

TCGGCAAGGCCTTCGGAATGAAAGTGACGGTGATCAGCTCGTCGCCGGGGAAGAAGGAGG
721  ---------+---------+---------+---------+---------+---------+  780
      G   K   A   F   G   M   K   V   T   V   I   S   S   S   P   G   K   K   E   E
```

FIGURE 14

```
       AGGCCCTGGGGCGGCTGGGCGCCGACGCGTTCATCGTCAGCAAGGACGCCGACGAGATGA
  781  ---------+---------+---------+---------+---------+---------+   840
         A  L  G  R  L  G  A  D  A  F  I  V  S  K  D  A  D  E  M  K

AGGCTGTGATAGCACCATGGATGGCATCANTAAACACGGTATCTGCAAACATCCCCCTGA
  841  ---------+---------+---------+---------+---------+---------+   900
          A  V  I  A  P  W  M  A  S  X  N  T  V  S  A  N  I  P  L  T

CCCCTCTCTTCGGGCTGCTCAAGCCCAACGGCAAGATGATCATGGTCGGCCTCCCCGAGA
  901  ---------+---------+---------+---------+---------+---------+   960
           P  L  F  G  L  L  K  P  N  G  K  M  I  M  V  G  L  P  E  K

AGCCCATCGAGATTCCTCCCTTCGCTCTAGTTGCCACGAATAAGACCCTGGCCGGGAGCA
  961  ---------+---------+---------+---------+---------+---------+  1020
            P  I  E  I  P  P  F  A  L  V  A  T  N  K  T  L  A  G  S  I

TCATCGGCGGCATGAGCGACACGCAGGAGATGCTGGACCTCGCGGCGAAGCACGGCGTGA
 1021  ---------+---------+---------+---------+---------+---------+  1080
             I  G  G  M  S  D  T  Q  E  M  L  D  L  A  A  K  H  G  V  T

CGGCCGACATCGAGGTGGTCGGCGCGGAGTATGTGAACACGGCCTTGGAGCGCCTTGCCA
 1081  ---------+---------+---------+---------+---------+---------+  1140
            A  D  I  E  V  V  G  A  E  Y  V  N  T  A  L  E  R  L  A  K

AGAACGACGTCAGGTATCGCTTCGTCATCGACATCGGCAACACCCTCGACAATGTTGCGG
 1141  ---------+---------+---------+---------+---------+---------+  1200
            N  D  V  R  Y  R  F  V  I  D  I  G  N  T  L  D  N  V  A  A

CCACCACCGAGTGAACGTACTCAGCACTGCTTACGATCTACGTTGTTCCACTGTTAGTGC
 1201  ---------+---------+---------+---------+---------+---------+  1260
          T  T  E  *

TCCGTAGTAAACAATAAACGATCAAAACTCTTGTCATCTGGTGCATTGGTGTAGACATGG
 1261  ---------+---------+---------+---------+---------+---------+  1320

TTGTTTGCGAGGAAACTGAGTTGAAGGATGGATGGATAAAAAAAAAAAAAAAAAAAAAA
 1321  ---------+---------+---------+---------+---------+--------    1378
```

FIGURE 14 CONTINUED

```
                              pBluescript
                   GCGGCCGCTCTAAAACTAGTGGATCCCCCGGGCTGCAGGAATTCGATATCAAGCTTATnG
                        SalI
                   ATACCGTCGACAGCGGTTnCAAATCGCCGGTCCTGGGGTGGAAGTGnAGCAGTGGGAAGA
                   +---------+---------+---------+---------+---------+---------  -4581

TGTGTGCGAGGGGTTGTGTTTTGGATGnAAGACAGGCGGGCCAGTGGAGAACAAGAGAGA
-4580     +---------+---------+---------+---------+---------+---------           -4521

ACGCGAGAGGCCAAAGTATCCGCAGCCCCGCAAACAAGGCCTAGATTTGGGTTAAGTTTG
-4520     +---------+---------+---------+---------+---------+---------           -4461

GGTCGTCTCAGACACCGCGGCCATCCTTTTAGGTGGTCCGCGCGCTGGACCGTATTTTTA
-4460     +---------+---------+---------+---------+---------+---------           -4401

TCTGAGTTGACCCATTCAGACGCGCAGACACGAGATGGATGGTGCAGTwAgAGATGACCT
-4400     +---------+---------+---------+---------+---------+---------           -4341

HindIII
          AAGTACAArAACCTCTCCCCGA.GCTGCCGCCATCcGTCACTTACCGAGCGAcAAAGcTT
-4340     +---------+---------+---------+---------+---------+---------           -4281

CCCACTTCATCACACTCAGCCCAGCAAGCATACTGATGGTGAGCGCACTCGCGGCTGTGC
-4280     +---------+---------+---------+---------+---------+---------           -4221

CCACCGACCCCACGCCATCCAAAACCAACTCTACTTTTCACCmCACCAACAAAAGACAAA
-4220     +---------+---------+---------+---------+---------+---------           -4161

ATATGGTGGATTTTGTGATGAGATGGAAGCGGAGCTTGTCAGAATGGGAAACGCATAAAT
-4160     +---------+---------+---------+---------+---------+---------           -4101

CGAGAACACGTATACAGTGCTGGAAATTGGATGACTAAGCCCCAAGGGTTAGAAAAAAAA
-4100     +---------+---------+---------+---------+---------+---------           -4041

XbaI
          TnAGACCATGTCTAGATGGAATTAGACATTTTTTGATATAATAGAAGCGGGACTTGGCGC
-4040     +---------+---------+---------+---------+---------+---------           -3981

GACAATTTCAAACTTCGTCCCTAACAGGTATCGAACtTTCGAtAGTTAGCGTGTGCTACT
-3980     +---------+---------+---------+---------+---------+---------           -3921

GCggAcCCCCAACCACtTGTGTTAAGCCCACATCgGTTAAGGCCCAAGGGTTAGATGAAA
-3920     +---------+---------+---------+---------+---------+---------           -3861

GTACCAATCTCACTCATTTGCGACTAGCTACAAAACTTGCTTTTCACATGTACGGTCATA
-3860     +---------+---------+---------+---------+---------+---------           -3801

CTACAATTTTGACCTTGGTAACGTAAGTATGGACTGTATGGTGTGCTAAGGTGTGTTGGC
-3800     +---------+---------+---------+---------+---------+---------           -3741

AGCTCAAATAAACCCAAAAATTTCAACACACGTCAACCATGAACTGAGATTCACACCAAC
-3740     +---------+---------+---------+---------+---------+---------           -3681

GGCTGAGCCGTCTCCTTTAAAAGATAGAGGGAGAAAACCATAATCACCATTGGTGGTCAT
-3680     +---------+---------+---------+---------+---------+---------           -3621

GTGTGAGTGTGCAAGCAAAAAAAAATGGAGAAGCCAAAACCCGTTGAGAGAGTGCGAGAG
-3620     +---------+---------+---------+---------+---------+---------           -3561

CATACAAGAACACCACAACAAAGTGTGAAGGAGAAAAAGAATATGAGATAAGATTTCGGA
-3560     +---------+---------+---------+---------+---------+---------           -3501
```

FIGURE 18

```
        AATACTTTTGCACACCCATGCATGGGTGTGGGTGTTTCCGTCACCGTCTATGTATTTCTC
-3500   +---------+---------+---------+---------+---------+---------   -3441

GAAATTCATGCCCACCATGGTAGATAAAAATATTTTTTTCTCTCTCCTCTTTTTATTCAA
-3440   +---------+---------+---------+---------+---------+---------   -3381

ATCTCAAAGCAtAAkrArTGGTGACAGAACGATAAGATTCCTACCTAGCTTTCTGAGATC
-3380   +---------+---------+---------+---------+---------+---------   -3321

CCACTAGTTTATCTTCAAGCTGGTGATTGAAGGATTAACCATGCTTGAATTAGATTGGCT
-3320   +---------+---------+---------+---------+---------+---------   -3261

TCAAACTTGGTAGTAGCTTGTTTCATACTTTGATTACTTTGGTATGGTTAGTTGGTTTGA
-3260   +---------+---------+---------+---------+---------+---------   -3201

GATTTTGGTCAATGTAGAATCAGATTTGAGAGCGATTGTCAGCTTGAATTGCCGCAGTTT
-3200   +---------+---------+---------+---------+---------+---------   -3141

TAGCACATACTAGTTTGGATAGATGAACAGTTTGGAGAGACAAATAATGTCTATACGAGC
-3140   +---------+---------+---------+---------+---------+---------   -3081

TCATCGGATAATATTAGTCTATGGCTTTTGCTTCGGTGTCCCCTCTGCAAACTTTACCCC
-3080   +---------+---------+---------+---------+---------+---------   -3021

TCTGTAGATGGTAGGATTTTCTGATATCCTTTCATGGTTTAAGGGTGTGCGTGTAAGGAA
-3020   +---------+---------+---------+---------+---------+---------   -2961

CGGGAGATACCGGATCACACCTTTTCGTCTACACTTTACAAGCATGTAACACCTAAGATT
-2960   +---------+---------+---------+---------+---------+---------   -2901

GATTGATATCTAGGCTTACACCCCAATGGAGGTAAACTAATATTATTGAAATGCGACTTT
-2900   +---------+---------+---------+---------+---------+---------   -2841

TCAAAAGTCCCAATATAACCTTGACGATGATCTTACAACTACTCGCGCCAGTCTTGTATG
-2840   +---------+---------+---------+---------+---------+---------   -2781

KpnI
        ATATCAGATTGGCCGAGGATCGTGGGTACCTTGTAGTGGACTATGATGCTCATGGAGGTT
-2780   +---------+---------+---------+---------+---------+---------   -2721

GTATGGACATGTTGTAATGCTGGTTTTCTCTAGGTTTTTTCTAATCAACTTGGCATTCTT
-2720   +---------+---------+---------+---------+---------+---------   -2661

CTCCTTAACACATAATAAGAGGGAATACCTCCATACATTATTCTGAAAAAAGCATGGCCA
-2660   +---------+---------+---------+---------+---------+---------   -2601

ACAATGAAACAGAAACAAGTACGACAGTCTATACCCGACCCAAACAATGGCTCAGGTCTT
-2600   +---------+---------+---------+---------+---------+---------   -2541

TCACGATGCATAGTTTGTTAGCATGTATTTTATAGTAGGAACTAAAATTTAAAGACAACT
-2540   +---------+---------+---------+---------+---------+---------   -2481

TGCnAAAACAATTTTGTCTCTTGAGTGTTTTTTAAGGATGCGGCATTTATCGATTATACA
-2480   +---------+---------+---------+---------+---------+---------   -2421

TTACATATGTGATTGGATtAGCCAACTTTTTGTCTTCCgATGATCATATGAAAGGGTTGT
-2420   +---------+---------+---------+---------+---------+---------   -2361

ATCTTAGGGCATCTCCAATGGGnAGACTCAAATGCAAAAAAATnGTCCGTTTGGGTCTTC
-2360   +---------+---------+---------+---------+---------+---------   -2301

CnGGACAAAACCTGCTCCCAACGGGGCAACCCAACTTAAAAACGGACAGGTGCAGCGTCC
-2300   +---------+---------+---------+---------+---------+---------   -2241
```

FIGURE 18 CONTINUED

```
       GGCnTGACCCAAAACTGACGCAAATTTGGnAnATTTTTGGGGCnAGCCAGACGAACGCGG
-2240  +---------+---------+---------+---------+---------+---------  -2181

GCGTCCACTGTATCCGACTATGTCCGCATCCTGGCCCATCTGACAGTGACACAAAATACA
-2180  +---------+---------+---------+---------+---------+---------  -2121

ACCACATGCGCCCCCCACCCTTCTCTCTCCTCCGTTCGCCTTTTCCCATGGAAnCnGTCC
-2120  +---------+---------+---------+---------+---------+---------  -2061

TCGCTCCTCGCCGGAATTGATCTCGCCTAACCATGCTCCGCCGCCACCcTCGcCTkAAGG
-2060  +---------+---------+---------+---------+---------+---------  -2001

CCCCAgCCGCCGCTACcTCCTTTTTGTCAGCCCTATTgGAAGTCGCCGgAGTTGAAACGA
-2000  +---------+---------+---------+---------+---------+---------  -1941

GCGCCGCCAGCCTcGACACCGCCGAGCAAGACGAAGACTGGGCGGAGCTCGCCGAGACGG
-1940  +---------+---------+---------+---------+---------+---------  -1881

GACGGGGACGGAGCTCGCCATGCGTGCCTCGCAGGGGCGCGATGGGGGCGGAGCTCGCCG
-1880  +---------+---------+---------+---------+---------+---------  -1821

PstI
       TGGCTGGCTGCAGCACCTCGGGCCGCTGCTAGCCGTGCCACGACGCGAGCATGCGCCTCG
-1820  +---------+---------+---------+---------+---------+---------  -1761

ACGCCGCCCCGTGCTACCTCGTCGCGCGCCCAGGGCCGCCCCGCCCCTGCCGACCGgCGg
-1760  +---------+---------+---------+---------+---------+---------  -1701

CGgAgACGCGAcCTTCGCGgACGTGCCCGGCGGCAGAGACGCGTCCTTCGCGACAGCGCC
-1700  +---------+---------+---------+---------+---------+---------  -1641

CTCCTCGATCTCCGTCGAGCCGCATACGCGgCgTAgGAgGGACGCGGGCGTCCCCGGTGTC
-1640  +---------+---------+---------+---------+---------+---------  -1581

GGCCTCCGTTGTGGCGCATCGCGGGCGCGGCCTCCGTCGAGGCGCATCGCGGGCGTGGCC
-1580  +---------+---------+---------+---------+---------+---------  -1521

TCGTGGCGCAGCCTGCCCTGATTCGGTCTGAGGCGCGGCGCGGAGCTTCCTCGCGGCGGC
-1520  +---------+---------+---------+---------+---------+---------  -1461

GCGGGCGGAGCCTCCTCGCTGCGGCGCGACCTGCTCTGCCGCGGTCCGAGACGCGGCGCG
-1460  +---------+---------+---------+---------+---------+---------  -1401

GGCAGAGCTTCCTCGCGGCGGCTCGGGCGCGGCTTCCTCGCGGCGATGGCGCTTCCAGGC
-1400  +---------+---------+---------+---------+---------+---------  -1341

TCGCACGCGGCCTCCGGCGTGGCGCAGCGAGAGCGCAGCCTCCGGTGAGTTAGGCACAGG
-1340  +---------+---------+---------+---------+---------+---------  -1281

CGCGACACGACATCCCCGGCCTCGGCCTCCGGCGTGGCGCAGCGCGAGCGCGACGTAGCC
-1280  +---------+---------+---------+---------+---------+---------  -1221

TAGGTTGGCAACTAGTaCTACGAGGAAGAAAGAGGAGAAACAATTATTTGGGTCACAGCG
-1220  +---------+---------+---------+---------+---------+---------  -1161

TTGGGCGTACTGTGCGATCCAAACGGACACCCgGACGCGAaACGATGTCAGCGTGTCCGC
-1160  +---------+---------+---------+---------+---------+---------  -1101

GTGGcGACCCAAACGACCCGAAACGGACGTCcGTTTGGGTCGGTGCGTTGGAGATGCCCT
-1100  +---------+---------+---------+---------+---------+---------  -1041

TACTCCCCATCCTCAAATGAGTCTAATTATATATCTTGTTGTAAGTTTTAAAAAAGTTAA
-1040  +---------+---------+---------+---------+---------+---------   -981
```

FIGURE 18 CONTINUED

```
        ACTTTGATCAACATTAGTAATGATAGTAGCAACGAATACAAAATTAAATTGTAAAAATAT
-980    +---------+---------+---------+---------+---------+---------   -921

ATTATGAAACTTTATTTTAAGATGGATCTAGTTATACTAATTTTCTGCGGATGGAGGAAG
-920    +---------+---------+---------+---------+---------+---------   -861

TAGCTAAATATTGTTAATTTCTAAATAAAAAATTAAAACTTTAACTTAAAACAAAAGTTA
-860    +---------+---------+---------+---------+---------+---------   -801

Putative Myb Binding domains
        CAAGCATAATTATCTGtGGATGGAGGAAGtAGCTAAGATACACCAATCCTCTCTCTACAT
-800    +---------+---------+---------+---------+---------+---------   -741

TACCTAGCATGCCACATCAGGAAACTATTTAGGATAAGCTCCAAGGAACCACCCAGAACA
-740    +---------+---------+---------+---------+---------+---------   -681

ACAATTTACATGGCCTGGCTAACCTAATGACAATTTCCGAGCAACTGGTGGTGGTGGTAC
-680    +---------+---------+---------+---------+---------+---------   -621

GCGTTCCTTGTTCAATTGTCTCTATTACAAGAGTGGCCCTGTATAGGTAAAAAAAAATAA
-620    +---------+---------+---------+---------+---------+---------   -561

HindIII                        PstI
        CAAGCTTCCAAGGACGGCCATGTTCCTTGTTCCTGCAGGCTGCACGTACTCACGACGAAG
-560    +---------+---------+---------+---------+---------+---------   -501

TGTATCTCGTGTTCTGGACATTTGTCTCGCGCATTTTGTAACCATGAAATTAAAAATGTG
-500    +---------+---------+---------+---------+---------+---------   -441

GTGGCCTGCTATATCTGTATGGGGGTATCATGCACTCCTTCGCAGAGGAATCCAGACGAC
-440    +---------+---------+---------+---------+---------+---------   -381

GATTTACACGTGTTTCCACCTTAGCTTTTTTTAAGTGTGTGTGTAAGGAACGATCATATA
-380    +---------+---------+---------+---------+---------+---------   -321

XhoI
        ACTGCCCCTGAATGCTGCATATATATAAACCGACTCCATCATGTACTCGAGACAAGGTCG
-320    +---------+---------+---------+---------+---------+---------   -261

TCAAGAAAAACAAACTATGCCTATCTCACTAGCAATGATTTGAGAGTACAGCTTTTCCGG
-260    +---------+---------+---------+---------+---------+---------   -201

TGCCATATTTTTTCCTATATATCTTTTTCTGAAGAACAAGAAAAAAAAAACAGTTGGTGT
-200    +---------+---------+---------+---------+---------+---------   -141

GGTGGTTGGTGAAGCGAGAAAGCCCCATATAAGCCCTGCTCACCCTCCCCGCAAAGCACA
-140    +---------+---------+---------+---------+---------+---------   -81

PvuI
        ACTCATAGCTCGGGTCTCTCGCTCACACCAAAATCGCCCACCAGCACCAGCATCTCTCGA
-80     +---------+---------+---------+---------+---------+---------   -21

TCGGCAGACGCATAGATCGATGGGCTCCACCGCCGCCGACATGGCCGCGTCCGCGGACGA
-20     +---------+---------+---------+---------+---------+---------   39
                                       M  G  S  T  A  A  D  M  A  A  S  A  D  E

GGACGCGTGCATGTTCGCCCTCCAGCTCGCTTCCTCGTCGGTCCTCCCGATGACGCTGAA
40      +---------+---------+---------+---------+---------+---------   99
           D  A  C  M  F  A  L  Q  L  A  S  S  S  V  L  P  M  T  L  K

GAACGCCATCGAGCTTGGCCTCCTGGAGATCCTGGTGGCCGCCGGCGGCAAGTCGCTGAC
100     +---------+---------+---------+---------+---------+---------   159
           N  A  I  E  L  G  L  L  E  I  L  V  A  A  G  G  K  S  L  T

CCCGACCGAGGTGGCCGCCAAGCTCCCGTCCGCGGCGAACCCGGAAGCGCCGGACATGGT
160     +---------+---------+---------+---------+---------+---------   219
           P  T  E  V  A  A  K  L  P  S  A  A  N  P  E  A  P  D  M  V
```

FIGURE 18 CONTINUED

```
            GGACCGCATACTCCGGCTGCTCGCGTCGTACAACGTCGTGACGTGCCTGGTGGAGGAGGG
220    +---------+---------+---------+---------+---------+---------    279
             D  R  I  L  R  L  L  A  S  Y  N  V  V  T  C  L  V  E  E  G

CAAGGACGGCCGCCTCTCCCGGAGCTACGGCGCCGCGCCCGTGTGCAAGTTCCTCACCCC
280    +---------+---------+---------+---------+---------+---------    339
             K  D  G  R  L  S  R  S  Y  G  A  A  P  V  C  K  F  L  T  P

CAACGAGGACGGCGTCTCCATGGCGGCGCTCGCGCTCATGAACCAGGACAAGGTCCTCAT
340    +---------+---------+---------+---------+---------+---------    399
             N  E  D  G  V  S  M  A  A  L  A  L  M  N  Q  D  K  V  L  M

Intron/exon boundary
            GGAGAGCTG↓GTGAGTCTCTCAGTGGAGCTAGTTACTGTAGATCCGAATTCGTTCCCTTTA
400    +---------+---------+---------+---------+---------+---------    459
             E  S
                                    SalI        pBluescript
            GTGAGGGTTAATTCCGCGGCCGCGTCGACCTCGAGGGGGGGCCCGGTACCCAATTCGCCC
460    +---------+---------+---------+

TATAGTGAGTCGTATTACGCGCGCTCACTGGCCGTCGTTTTACAACGTCGTGACTGGGAA
            AACCCTGGCGTTACCCAACTTAATCGCCTTGCAGCACATCCCCCTTTCGCCAGCTGGCGT
            AATAGCGAAGAGGCCCGCACCGATCGCCCTTCCCAACAGTTGCGCAGCCTGAATGGCGAA
            TGGGACGCGCCCTGTAGCGGCGCATTAAGCGCGGCGGGTGTTGTG    744
```

FIGURE 18 CONTINUED

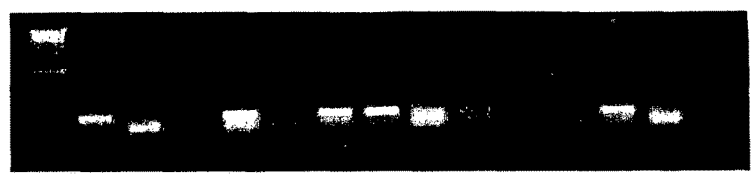
Fig. 20A
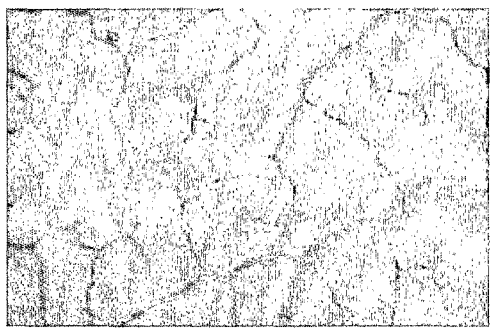
Fig. 20B
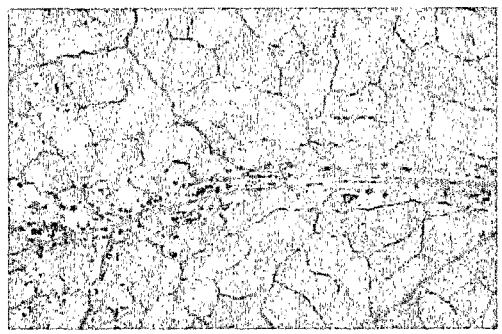
Fig. 20C
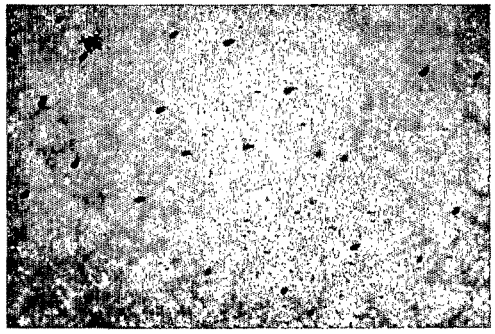
Fig. 20D
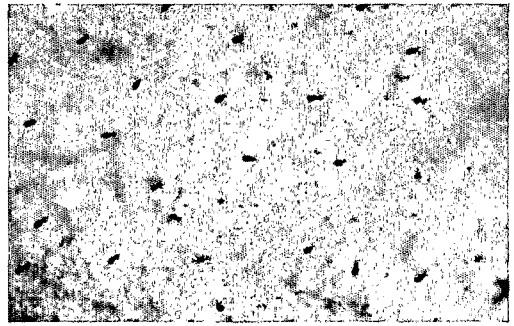

Fig. 21A
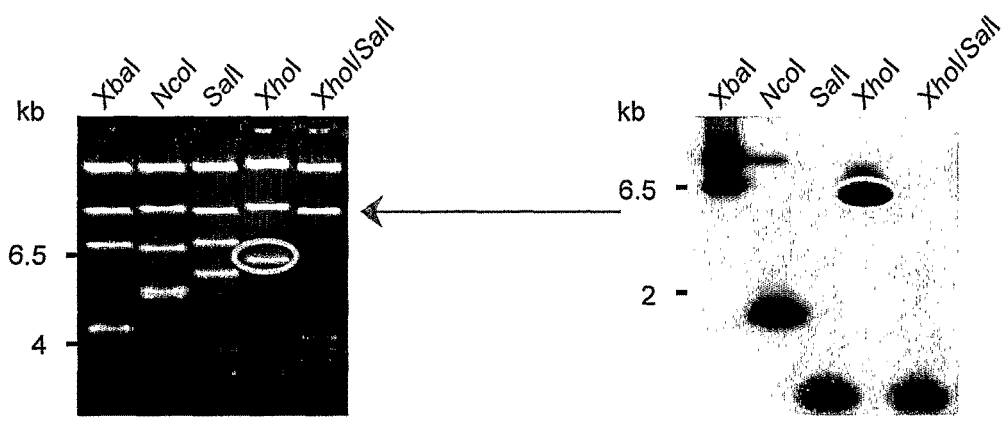
Fig. 21B
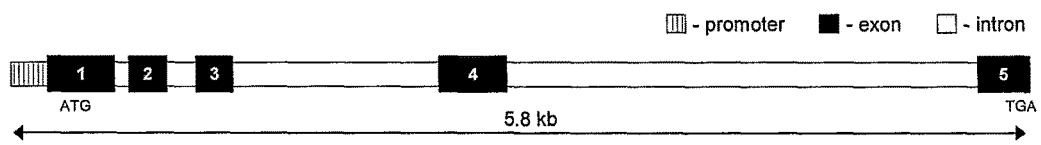
Fig. 21C
| Exon | LpCCR1 | EgCCR1 | EsCCR1 | PbCCR1 |
|---|---|---|---|---|
| 1 | 173 bp | 133 bp | 133 bp | 139 bp |
| 2 | 155 bp | 155 bp | 155 bp | 155 bp |
| 3 | 189 bp | 186 bp | 186 bp | 186 bp |
| 4 | 353 bp | 353 bp | 353 bp | 353 bp |
| 5 | 220 bp | 218 bp | 184 bp | 184 bp |

Fig. 22A
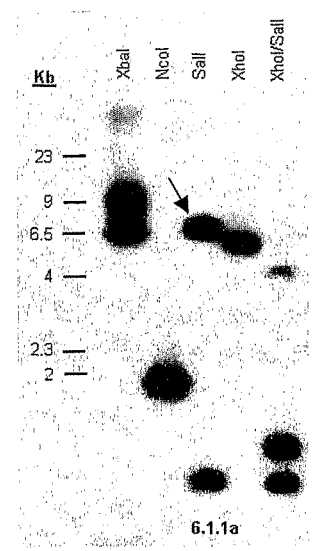
Fig. 22B
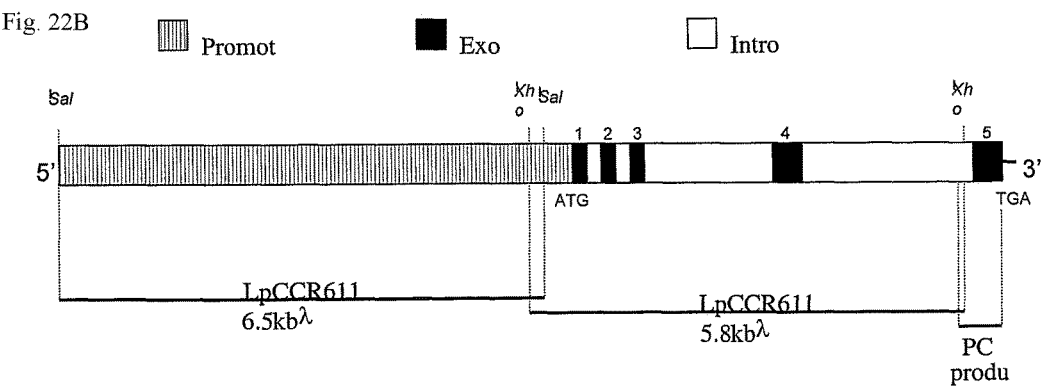
FIGURE 22

```
      TCCCGTATCTTCAACGTGACACCCCTACACTTCCTGCTTGTCTTGGAGATTTACACACAC
  1   ---------+---------+---------+---------+---------+---------+   60

ACGGCAATTACCAGGAGTATCTTCCTAGATTATTTTTTTCGATAAGGATCTTCCAGATAT
 61   ---------+---------+---------+---------+---------+---------+  120

AGCATGTGAATCTCTGTACTACTACTGTTTGTCAAGCAAAATTAACATTGACATCAGTGT
121   ---------+---------+---------+---------+---------+---------+  180

TTTTGTTGGGGGCAGCGGAATCTTTGACGCCTCTTCTTGCCTCTCAAGACATGTCACCCT
181   ---------+---------+---------+---------+---------+---------+  240

CACTAGTTAGTGTGCCAGCTGGTAGTACTACGTACGATGCTCCCTCCCTCCGTAATTATT
241   ---------+---------+---------+---------+---------+---------+  300

CAACCTTTTTGCTCTCTCTTTTTATAAAGTCAAACCTTTTAAATCTGACCAGATATCTGC
301   ---------+---------+---------+---------+---------+---------+  360

TAAAAAATTAGCAGACATGCATACATCAAAGCAGTAGTCCTCCCTCCGTTTAAAATTACC
361   ---------+---------+---------+---------+---------+---------+  420

TGGGTTTATTCAAATAAAGTCAAACTCTGTAAAATTCAATTAAATATTTAGAAAAATCTA
421   ---------+---------+---------+---------+---------+---------+  480

ACAGCACCTGTAGTATAAAAGTATGCTCCCTCTGTTTGTAAAAAAGCTAAGCAACTTTTT
481   ---------+---------+---------+---------+---------+---------+  540

TGAGATACGGATAAATCTTTAGCTAAAACATGTCTATATACCTTTGTATCTAGATAAAGT
541   ---------+---------+---------+---------+---------+---------+  600

TGGAAAGCTTTTTTAGAAACAGACAAAGTATGTGTTTGACATTATGAATGTTGAGTATTT
601   ---------+---------+---------+---------+---------+---------+  660

TTCCTCTAATCTTGATCAAATTTTACAAATTTTGGCTTGAATAGAGGGACCATTATTAGT
661   ---------+---------+---------+---------+---------+---------+  720

ATGAAACTACATAAATTTGTAAAACACTCAACATAATTTACGATGGGTCAGTGATAGCAC
721   ---------+---------+---------+---------+---------+---------+  780

TAACTTAGCTTTTCATAAATGCCACTGCTTTTCAATAGAGCATGAAGCAGGACAAATTTA
781   ---------+---------+---------+---------+---------+---------+  840

TTCGTGTGACTTGAATAGAGGGAGCCTGTTCTGGTTCAACTCACCCTGCATGTGTGTCTT
841   ---------+---------+---------+---------+---------+---------+  900

CATCCCTTTTGCTCTTCCTATCTGTGGTGTCAATTGAGTGTCCCACGTGCATGTGGGCGA
901   ---------+---------+---------+---------+---------+---------+  960
```

FIGURE 26

```
961   AACTTGAACCTAGAAATTGACATGCTCCCACTGCCCGGAGCGGAGTATCTTTGTGCTTTG
      ---------+---------+---------+---------+---------+---------+   1020

1021  TTACCCTTATTGTTGCTACGTACTACAGTGTTTAGATTGGAACTTCATAATCAAAAGAAC
      ---------+---------+---------+---------+---------+---------+   1080

1081  TTAGTTTCCTACAATTTTTTGCTAAGCAATATAATGAGCAATCAAACTTCTATATCTGTG
      ---------+---------+---------+---------+---------+---------+   1140

1141  GCAAATAACTAATCCATTATAGTTACAGTTTAGATGCAGACGCCAGTGTTTCTTCCCCTT
      ---------+---------+---------+---------+---------+---------+   1200

1201  TTCGGAAAAAGCTATTCCATAATAAGTGTTGGAAATTTAATAAATGGGTACTACGAATT
      ---------+---------+---------+---------+---------+---------+   1260

1261  TGAAAAAAAAGTGTCAAAAATTCACTAAGAAAGTACGTAGTACAAATTTAAACTAAGAT
      ---------+---------+---------+---------+---------+---------+   1320

1321  TCCGACACTTATTAGGATCGGAGAGAGTAAGTAGCAAACTACTACTCCATCCACCTAAAA
      ---------+---------+---------+---------+---------+---------+   1380

1381  CACGTGATTTAACTTTGTCTAGATACGGATAGAAAGTTGGGATACATCCGTATCTTAAAA
      ---------+---------+---------+---------+---------+---------+   1440

1441  AAAAACGCACTTATTTTAGACGAAGGAGGGAGTATTTCAACCTTGATTTTAAACGGAATC
      ---------+---------+---------+---------+---------+---------+   1500

1501  TACAAAGGGAATACATGGATTGTACAAGTGGGCTGACCGTATCCATTATGTACTCGTACT
      ---------+---------+---------+---------+---------+---------+   1560

1561  TTGCAGTTTGAAAGCAAAGGCTAGTGTAATTTGTAGGTGGTTCTAGGCGTCTAGCTGTTT
      ---------+---------+---------+---------+---------+---------+   1620

1621  CATGGCGTTATCACAGCCGTGCCAGTGTGCTCAGGGCCGTACATAAGTTGCTTGGTGTAT
      ---------+---------+---------+---------+---------+---------+   1680

1681  GTGTCGATCTAGGATTTGCCGTCTTACAATTTTGCTTTCCAACTTATTTTCTGTAAAGAG
      ---------+---------+---------+---------+---------+---------+   1740

1741  ATCGATGTGAACTTCTCTGTCGAGTAAACTGAAATTGTCTGAATAAATATAACTCGGCAG
      ---------+---------+---------+---------+---------+---------+   1800

1801  ATTATGTTTTATCGTTTGCATGCGTAACAGGCTACACAAATTGCTCGAGTCAGCAGCGAG
      ---------+---------+---------+---------+---------+---------+   1860

1861  TTGAGCTCACAACGAATCCATCAGCAAAAATACTATACTATAGTAGCACATCGTTTCTTT
      ---------+---------+---------+---------+---------+---------+   1920
```

FIGURE 26 CONTINUED

```
      TTTCATGACGTTTCTGTTTCTTCCTAACTTTCCAGGAGCACCGGAGACGACGATGTGGTG
1921  ---------+---------+---------+---------+---------+---------+  1980
                                        R  S  T  G  D  D  D  V  V

ATAAAGATTTTGTACTGCGGAATCTGCCACTCTGACCTGCACGCCCTGAAGAACGACTGG
1981  ---------+---------+---------+---------+---------+---------+  2040
      I  K  I  L  Y  C  G  I  C  H  S  D  L  H  A  L  K  N  D  W

AAGAACTCAAGGTACCCGATGATCCCCGGGCACGAGATCGCCGGCGAGGTCACGGAGGTG
2041  ---------+---------+---------+---------+---------+---------+  2100
      K  N  S  R  Y  P  M  I  P  G  H  E  I  A  G  E  V  T  E  V

GGCAAGAACGTGAGCAAGTTCAAGGCCGGCGACCGCGTGGGCGTCGGGTGCATGGTGAAC
2101  ---------+---------+---------+---------+---------+---------+  2160
      G  K  N  V  S  K  F  K  A  G  D  R  V  G  V  G  C  M  V  N

TCGTGCCGGTCGTGCGAGAGCTGCGACAAGGGCTTCGAGAACCACTGCCCGGGCATGATC
2161  ---------+---------+---------+---------+---------+---------+  2220
      S  C  R  S  C  E  S  C  D  K  G  F  E  N  H  C  P  G  M  I

CTCACCTACAACTCGGTCGACGTCGACGGCACCGTCACCTACGGCGGCTACTCCAGCATG
2221  ---------+---------+---------+---------+---------+---------+  2280
      L  T  Y  N  S  V  D  V  D  G  T  V  T  Y  G  G  Y  S  S  M

GTGGTGGTGCACGAGCGGTTCGTGGTCCGGTTCCCCGACGCCATGCCGCTGGACAAGGGC
2281  ---------+---------+---------+---------+---------+---------+  2340
      V  V  V  H  E  R  F  V  V  R  F  P  D  A  M  P  L  D  K  G

GCGCCGCTGCTGTGCGCCGGCATCACCGTGTACAGCCCCATGAAGTACCACGGGCTCAAC
2341  ---------+---------+---------+---------+---------+---------+  2400
      A  P  L  L  C  A  G  I  T  V  Y  S  P  M  K  Y  H  G  L  N

GTTCCCGGGCTGCACCTCGGCGTGCTGGGGCTGGGCGGGCTGGGCCACGTTGCGGTCAAG
2401  ---------+---------+---------+---------+---------+---------+  2460
      V  P  G  L  H  L  G  V  L  G  L  G  G  L  G  H  V  A  V  K

TTCGGCAAGGCCTTCGGAATGAAAGTGACGGTGATCAGCTCGTCGCCGGGGAAGAAGGAG
2461  ---------+---------+---------+---------+---------+---------+  2520
      F  G  K  A  F  G  M  K  V  T  V  I  S  S  S  P  G  K  K  E

GAGGCCCTGGGGCGGCTGGGCGCCGACGCGTTCATCGTCAGCAAGGACGCCGACGAGATG
2521  ---------+---------+---------+---------+---------+---------+  2580
      E  A  L  G  R  L  G  A  D  A  F  I  V  S  K  D  A  D  E  M

AAGGTAGGCGGACCCGCTGGTTCAGGTTACTTCCCCTGTCCGGTGCAGAAGAAAGAGGAA
2581  ---------+---------+---------+---------+---------+---------+  2640
      K
```

FIGURE 26 CONTINUED

G at 851 bp (coding sequence) missing from cDNA in cv Ellett
▼

```
       CTTGAGGGTTCATGTTTGTTTTGCGTTGGTGATGTCTTTGCAGGCTGTGATGAGCACCAT
2641   ---------+---------+---------+---------+---------+---------+   2700
                                                   A  V  M  S  T  M

GGATGGCATCATAAACACGGTATCTGCAAACATCCCCCTGACCCCTCTCTTCGGGCTGCT
2701   ---------+---------+---------+---------+---------+---------+   2760
        D  G  I  I  N  T  V  S  A  N  I  P  L  T  P  L  F  G  L  L

CAAGCCCAACGGCAAGATGATCATGGTCGGCCTCCCCGAGAAGCCCATCGAGATTCCTCC
2761   ---------+---------+---------+---------+---------+---------+   2820
         K  P  N  G  K  M  I  M  V  G  L  P  E  K  P  I  E  I  P  P

CTTCGCTCTAGTTGCCAGTAAGTCTTAGGATCTCTTGCAATAAGGAGAAATCATGCACTG
2821   ---------+---------+---------+---------+---------+---------+   2880
         F  A  L  V  A

ATCGATCAGAGAAATGAGATAGCATCCTGATGAACATTGTACGTGTGTGCAGCGAATAAG
2881   ---------+---------+---------+---------+---------+---------+   2940
                                                             N  K

ACCCTGGCCGGGAGCATCATCGGCGGCATGAGCGACACGCAGGAGATGCTGGACCTCGCG
2941   ---------+---------+---------+---------+---------+---------+   3000
        T  L  A  G  S  I  I  G  G  M  S  D  T  Q  E  M  L  D  L  A

GCGAAGCACGGCGTGACGGCCGACATCGAGGTGGTCGGCGCGGAGTATGTGAACACGGCC
3001   ---------+---------+---------+---------+---------+---------+   3060
        A  K  H  G  V  T  A  D  I  E  V  V  G  A  E  Y  V  N  T  A

TTGGAGCGCCTTGCCAAGAACGACGTCAGGTATCGCTTCGTCATCGACATCGGCAACACC
3061   ---------+---------+---------+---------+---------+---------+   3120
        L  E  R  L  A  K  N  D  V  R  Y  R  F  V  I  D  I  G  N  T

CTCGACAAGGTTGCGGCCACCACCGAGTGAACGTACTCAGCACTGCTTACGATCTACGTT
3121   ---------+---------+---------+---------+---------+---------+   3180
        L  D  K  V  A  A  T  T  E  *

GTTCCACTGTTAGTGCTCCGTAGTAAACAATAAACGATCAAAACTCTTGTCATCTGGTGC
3181   ---------+---------+---------+---------+---------+---------+   3240

ATTGGTGTAGACATGGTTGTTTGCGAGGAAACTGAGTTGAAGGATGGATGGATAAGTTTG
3241   ---------+---------+---------+---------+---------+---------+   3300

CTTCTTGCCGTGTTAATGGATTACCTACTTAGCTTCACTGCAATTAACAAATTAAGAAAC
3301   ---------+---------+---------+---------+---------+---------+   3360

GACACACCCAAAAGACTTTCGTCAGTTTTCTTGGATTATACAAGTCGTTATGGTTGGGTG
3361   ---------+---------+---------+---------+---------+---------+   3420
```

FIGURE 26 CONTINUED

```
3421  TCAGTGTGTCACAGATAATCATACTATGGTATTTAACCTGGAAGATCGTTTTTTTGGCGG  3480

3481  CAACTCAGTGGGTTTTCCCACTATGTATATTTATAAATATTCAACAAGTCATGAGGTACA  3540

3541  AAGGGTTGTTGCTAGAGGATAGCAACAAGAAGCTAGCCAAAAGATCATAGGCTTAAAAAA  3600

3601  GAGAGAAAAGAAAACAAAACTGCTATAGTTATCGAAATCTCTCAGCTCAAATTTTAAAAC  3660

3661  CAGCATAAGACTTTCTAGAAGCCTTATGAACAAGAAGAGCTAGCTCATCTTTAAACCTTT  3720

3721  TCCTGCATCTGTAAAGATTGAGGGTGCAACCCTTGAATATAAAATCATTCCTGTCATCCA  3780

3781  GATAGACTATGTAGTCAAAATAGTCATTTCCATGAAGAAGGGCACTTTTAATACATTTTT  3840

3841  GAGACTTGGTATGATACTCTGAATGTCAACACCCTGGAAGATCTTTTCACTCCTATGGAA  3900

3901  GGACAAGAAAGCATTTCAACTCCTTTTACTAAGGAAGAGATTGACAAGGTGATTCAGAGA  3960

3961  ATTCCTTTAGACACTATAGAAAGTCACAAGGTGCCAACGGCGCAATCCTGTGCCGACGGC  4020

4021  TTTTTATCGGGGAAGCCAGCATCGGTACCGAGACCGGCAGCCCACCAACTAGGCCGTCGG  4080

4081  CACACATCCTCCAGTGTCGGCGGCCAACATCGGCATAAGTTGGCCCGTTGGGCATCAACT  4140

4141  CCCCCGTCGGAACAGGTCTAGCGCATGGACCGTCGTGATGGCGGCGGCAACGACGTCATC  4200

4201  CTATGCCGACGGCCTAGCCGTCGGCCTAGCTTGCCAGCGCTATGCCGACGTCACATTGCC  4260

4261  ATCGGCACATGCTAGTTTTTTTTTCTTTTTTCTACATGCCAAATTGTATATGTATATATA  4320

4321  CTCATTTACTTATTACTTCCAATTATTTTAATGTGTATATATTTTGCTCACCAATTGTAC  4380
```

FIGURE 26 CONTINUED

```
       GAATTTGTACCCTCCGAGAAATTGCTAAAATGATGGAGTGACCTACAACGAGCCTTGGAT
4381   ---------+---------+---------+---------+---------+---------+   4440

ATGTGAGTTCTTCTTGCCCCATTGCACAAAAATTGTAAATATTAGGGTTTACTGGATCCA
4441   ---------+---------+---------+---------+---------+---------+   4500

CTAGTTCTAGAGCGGCCGCCACCGCGGGGAGCTCCAGCTTTTGTTCCCTTTAGTA
A)     ---------+---------+---------+---------+---------+-----   4555
```

FIGURE 26 CONTINUED

```
      GGCACGAGTCGCCTCCAACGTCTTCCCTTAACCGGCCGTCCCTACGCtTGCACCACCACC
   1  ---------+---------+---------+---------+---------+---------+   60

ACGCACAGACAGAGCAGTTTCCCAGCCCCGCCGGAACCGGATGGCACCCACGGCGGCGG
  61  ---------+---------+---------+---------+---------+---------+  120
                                                M  A  P  T  A  A  E

AGCAGACGGAGCACCACCAGCACACCAGGAAGGCGGTGGGGCTGGCGGCGCGCGACGACG
 121  ---------+---------+---------+---------+---------+---------+  180
       Q  T  E  H  H  Q  H  T  R  K  A  V  G  L  A  A  R  D  D  A

CCGGCCACCTCTCCCCGCTCGCCATCACACGGAGGAGCACAGGAGACGACGATGTGGTGA
 181  ---------+---------+---------+---------+---------+---------+  240
       G  H  L  S  P  L  A  I  T  R  R  S  T  G  D  D  D  V  V  I

TAAAGATTTTGTACTGCGGAATCTGCCACTCTGACCTGCACGCCCTGAAGAACGACTGGA
 241  ---------+---------+---------+---------+---------+---------+  300
        K  I  L  Y  C  G  I  C  H  S  D  L  H  A  L  K  N  D  W  K

AGAACTCAAGGTACCCGATGATCCCCGGGCACGAGATCGCCGGCGAGGTCACGGAGGTGG
 301  ---------+---------+---------+---------+---------+---------+  360
         N  S  R  Y  P  M  I  P  G  H  E  I  A  G  E  V  T  E  V  G

GCAAGAACGTGAGCAAGTTCAAGGCCGGCGACCGCGTGGGCGTCGGGTGCATGGTGAACT
 361  ---------+---------+---------+---------+---------+---------+  420
         K  N  V  S  K  F  K  A  G  D  R  V  G  V  G  C  M  V  N  S

CGTGCCGGTCGTGCGAGAGCTGCGACAAGGGCTTCGAGAACCACTGCCCGGGCATGATCC
 421  ---------+---------+---------+---------+---------+---------+  480
         C  R  S  C  E  S  C  D  K  G  F  E  N  H  C  P  G  M  I  L

TCACCTACAACTCGGTCGACGTCGACGGCACCGTCACCTACGGCGGCTACTCCAGCATGG
 481  ---------+---------+---------+---------+---------+---------+  540
         T  Y  N  S  V  D  V  D  G  T  V  T  Y  G  G  Y  S  S  M  V

TGGTGGTGCACGAGCGGTTCGTGGTCCGGTTCCCCGACGCCATGCCGCTGGACAAGGGCG
 541  ---------+---------+---------+---------+---------+---------+  600
         V  V  H  E  R  F  V  V  R  F  P  D  A  M  P  L  D  K  G  A

CGCCGCTGCTGTGCGCCGGCATCACCGTGTACAGCCCCATGAAGTACCACGGGCTCAACG
 601  ---------+---------+---------+---------+---------+---------+  660
         P  L  L  C  A  G  I  T  V  Y  S  P  M  K  Y  H  G  L  N  V

TTCCCGGGCTGCACCTCGGCGTGCTGGGGCTGGGCGGGCTGGGCCACGTTGCGGTCAAGT
 661  ---------+---------+---------+---------+---------+---------+  720
         P  G  L  H  L  G  V  L  G  L  G  G  L  G  H  V  A  V  K  F

TCGGCAAGGCCTTCGGAATGAAAGTGACGGTGATCAGCTCGTCGCCGGGGAAGAAGGAGG
 721  ---------+---------+---------+---------+---------+---------+  780
         G  K  A  F  G  M  K  V  T  V  I  S  S  S  P  G  K  K  E  E
```

FIGURE 27

```
                AGGCCCTGGGGCGGCTGGGCGCCGACGCGTTCATCGTCAGCAAGGACGCCGACGAGATGA
         781   ---------+---------+---------+---------+---------+---------+   840
                  A  L  G  R  L  G  A  D  A  F  I  V  S  K  D  A  D  E  M  K

G at 851 bp (coding sequence) missing from cDNA in cv Ellett
                                              ▼
                AGGCTGTGATGAGCACCATGGATGGCATCATAAACACGGTATCTGCAAACATCCCCCTGA
         841   ---------+---------+---------+---------+---------+---------+   900
                   A  V  M  S  T  M  D  G  I  I  N  T  V  S  A  N  I  P  L  T CCCCTCTCTTCGGGCTGCTCAAGCCCAACGGCAAGATGATCATGGTCGGCCTCCCCGAGA
         901   ---------+---------+---------+---------+---------+---------+   960
                   P  L  F  G  L  L  K  P  N  G  K  M  I  M  V  G  L  P  E  K AGCCCATCGAGATTCCTCCCTTCGCTCTAGTTGCCACGAATAAGACCCTGGCCGGGAGCA
         961   ---------+---------+---------+---------+---------+---------+  1020
                    P  I  E  I  P  P  F  A  L  V  A  T  N  K  T  L  A  G  S  I TCATCGGCGGCATGAGCGACACGCAGGAGATGCTGGACCTCGCGGCGAAGCACGGCGTGA
        1021   ---------+---------+---------+---------+---------+---------+  1080
                    I  G  G  M  S  D  T  Q  E  M  L  D  L  A  A  K  H  G  V  T CGGCCGACATCGAGGTGGTCGGCGCGGAGTATGTGAACACGGCCTTGGAGCGCCTTGCCA
        1081   ---------+---------+---------+---------+---------+---------+  1140
                   A  D  I  E  V  V  G  A  E  Y  V  N  T  A  L  E  R  L  A  K AGAACGACGTCAGGTATCGCTTCGTCATCGACATCGGCAACACCCTCGACAATGTTGCGG
        1141   ---------+---------+---------+---------+---------+---------+  1200
                   N  D  V  R  Y  R  F  V  I  D  I  G  N  T  L  D  N  V  A  A CCACCACCGAGTGAACGTACTCAGCACTGCTTACGATCTACGTTGTTCCACTGTTAGTGC
        1201   ---------+---------+---------+---------+---------+---------+  1260
                   T  T  E  *

TCCGTAGTAAACAATAAACGATCAAAACTCTTGTCATCTGGTGCATTGGTGTAGACATGG
        1261   ---------+---------+---------+---------+---------+---------+  1320

TTGTTTGCGAGGAAACTGAGTTGAAGGATGGATGGATAAAAAAAAAAAAAAAAAAAAA
    A)         ---------+---------+---------+---------+---------+--------   1378

GGCACGAGTCGCCTCCAACGTCTTCCCTTAACCGGCCGTCCCTACGCtTGCACCACCACC
           1   ---------+---------+---------+---------+---------+---------+    60

ACGCACAGACAGAGCAGTTTCCCAGCCCCCGCCGGAACCGGATGGCACCCACGGCGGCGG
          61   ---------+---------+---------+---------+---------+---------+   120
                                                           M  A  P  T  A  A  E

AGCAGACGGAGCACCACCAGCACACCAGGAAGGCGGTGGGGCTGGCGGCGCGCGACGACG
         121   ---------+---------+---------+---------+---------+---------+   180
                   Q  T  E  H  H  Q  H  T  R  K  A  V  G  L  A  A  R  D  D  A
```

FIGURE 27 CONTINUED

```
      CCGGCCACCTCTCCCCGCTCGCCATCACACGGAGGAGCACAGGAGACGACGATGTGGTGA
181   ---------+---------+---------+---------+---------+---------+   240
        G  H  L  S  P  L  A  I  T  R  R  S  T  G  D  D  D  V  V  I

TAAAGATTTTGTACTGCGGAATCTGCCACTCTGACCTGCACGCCCTGAAGAACGACTGGA
241   ---------+---------+---------+---------+---------+---------+   300
        K  I  L  Y  C  G  I  C  H  S  D  L  H  A  L  K  N  D  W  K

AGAACTCAAGGTACCCGATGATCCCCGGGCACGAGATCGCCGGCGAGGTCACGGAGGTGG
301   ---------+---------+---------+---------+---------+---------+   360
        N  S  R  Y  P  M  I  P  G  H  E  I  A  G  E  V  T  E  V  G

GCAAGAACGTGAGCAAGTTCAAGGCCGGCGACCGCGTGGGCGTCGGGTGCATGGTGAACT
361   ---------+---------+---------+---------+---------+---------+   420
        K  N  V  S  K  F  K  A  G  D  R  V  G  V  G  C  M  V  N  S

CGTGCCGGTCGTGCGAGAGCTGCGACAAGGGCTTCGAGAACCACTGCCCGGGCATGATCC
421   ---------+---------+---------+---------+---------+---------+   480
        C  R  S  C  E  S  C  D  K  G  F  E  N  H  C  P  G  M  I  L

TCACCTACAACTCGGTCGACGTCGACGGCACCGTCACCTACGGCGGCTACTCCAGCATGG
481   ---------+---------+---------+---------+---------+---------+   540
        T  Y  N  S  V  D  V  D  G  T  V  T  Y  G  G  Y  S  S  M  V

TGGTGGTGCACGAGCGGTTCGTGGTCCGGTTCCCCGACGCCATGCCGCTGGACAAGGGCG
541   ---------+---------+---------+---------+---------+---------+   600
        V  V  H  E  R  F  V  V  R  F  P  D  A  M  P  L  D  K  G  A

CGCCGCTGCTGTGCGCCGGCATCACCGTGTACAGCCCCATGAAGTACCACGGGCTCAACG
601   ---------+---------+---------+---------+---------+---------+   660
        P  L  L  C  A  G  I  T  V  Y  S  P  M  K  Y  H  G  L  N  V

TTCCCGGGCTGCACCTCGGCGTGCTGGGGCTGGGCGGGCTGGGCCACGTTGCGGTCAAGT
661   ---------+---------+---------+---------+---------+---------+   720
        P  G  L  H  L  G  V  L  G  L  G  G  L  G  H  V  A  V  K  F

TCGGCAAGGCCTTCGGAATGAAAGTGACGGTGATCAGCTCGTCGCCGGGGAAGAAGGAGG
721   ---------+---------+---------+---------+---------+---------+   780
        G  K  A  F  G  M  K  V  T  V  I  S  S  S  P  G  K  K  E  E

AGGCCCTGGGGCGGCTGGGCGCCGACGCGTTCATCGTCAGCAAGGACGCCGACGAGATGA
781   ---------+---------+---------+---------+---------+---------+   840
        A  L  G  R  L  G  A  D  A  F  I  V  S  K  D  A  D  E  M  K

G missing at 851 bp in the cDNA isolated from cv Ellett
          resulted in a premature stop codon (truncated CAD2)
                              ▼
      AGGCTGTGATAGCACCATGGATGGCATCATAAACACGGTATCTGCAAACATCCCCCTGAC
841   ---------+---------+---------+---------+---------+---------+   900
        A  V  I  A  P  W  M  A  S  *
```

FIGURE 27 CONTINUED

```
     CCCTCTCTTCGGGCTGCTCAAGCCCAACGGCAAGATGATCATGGTCGGCCTCCCCGAGAA
901  ---------+---------+---------+---------+---------+---------+  960

GCCCATCGAGATTCCTCCCTTCGCTCTAGTTGCCACGAATAAGACCCTGGCCGGGAGCAT
961  ---------+---------+---------+---------+---------+---------+  1020

CATCGGCGGCATGAGCGACACGCAGGAGATGCTGGACCTCGCGGCGAAGCACGGCGTGAC
1021 ---------+---------+---------+---------+---------+---------+  1080

GGCCGACATCGAGGTGGTCGGCGCGGAGTATGTGAACACGGCCTTGGAGCGCCTTGCCAA
1081 ---------+---------+---------+---------+---------+---------+  1140

GAACGACGTCAGGTATCGCTTCGTCATCGACATCGGCAACACCCTCGACAATGTTGCGGC
1141 ---------+---------+---------+---------+---------+---------+  1200

CACCACCGAGTGAACGTACTCAGCACTGCTTACGATCTACGTTGTTCCACTGTTAGTGCT
1201 ---------+---------+---------+---------+---------+---------+  1260

CCGTAGTAAACAATAAACGATCAAAACTCTTGTCATCTGGTGCATTGGTGTAGACATGGT
1261 ---------+---------+---------+---------+---------+---------+  1320

TGTTTGCGAGGAAACTGAGTTGAAGGATGGATGGATAAAAAAAAAAAAAAAAAAAAA
A)   ---------+---------+---------+---------+---------+-------  1377
```

FIGURE 27 CONTINUED

FIGURE 29A
A)
p35S4cl1
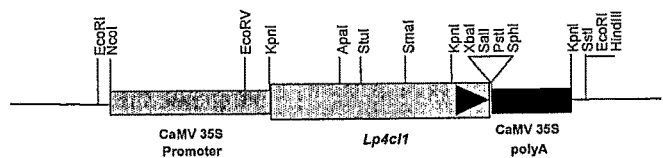
p35Slc41
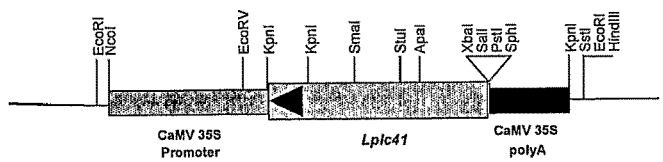
p35S4cl2
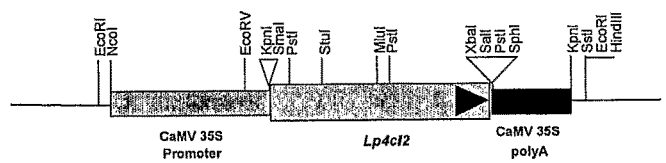
p35Slc43
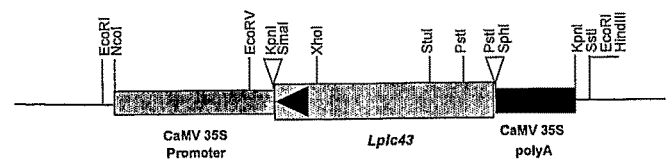
p35Slc42
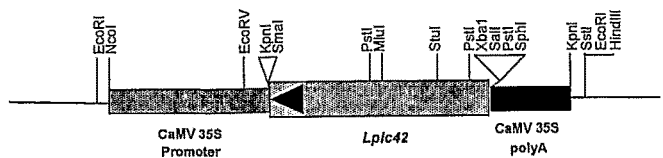
p35S4cl3
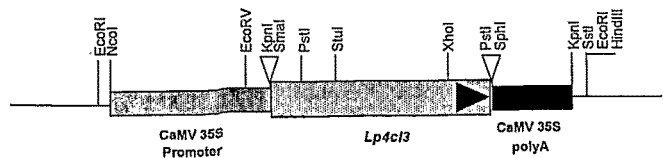

FIGURE 29B
B)
pUbi4cl1
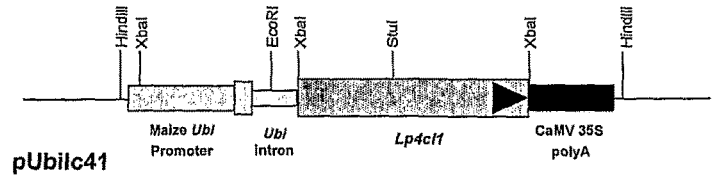
pUbilc41
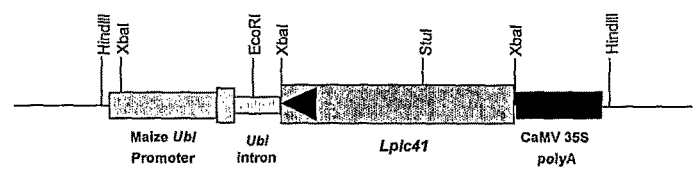
pUbi4cl2
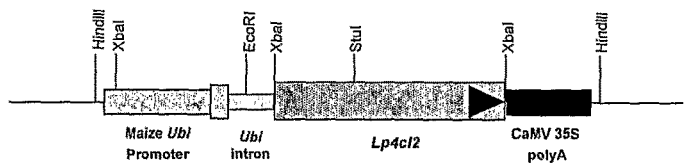
pUbilc42
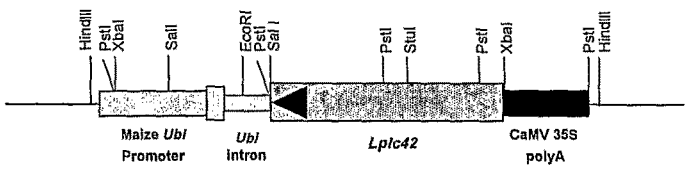
pUbi4cl3
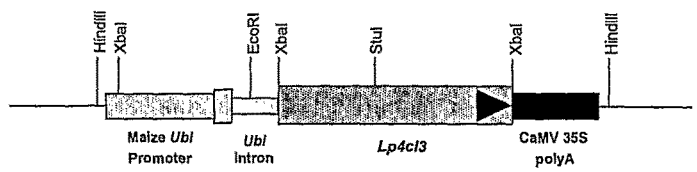
pUbilc43
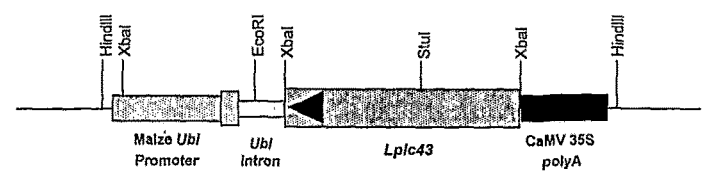

Fig. 31A
p35SCAD1
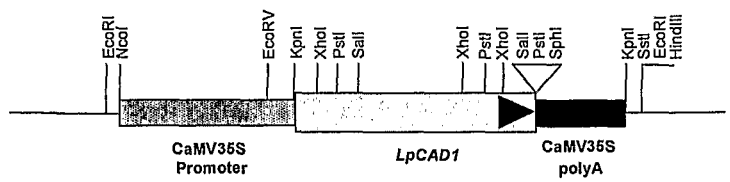
p35SDAC1
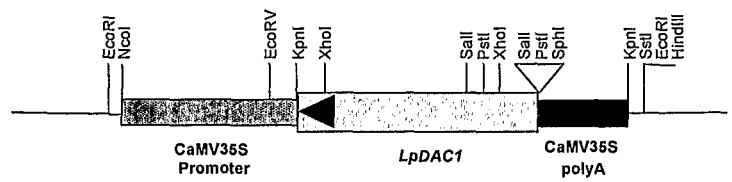
Fig. 31B
pUbiCAD1
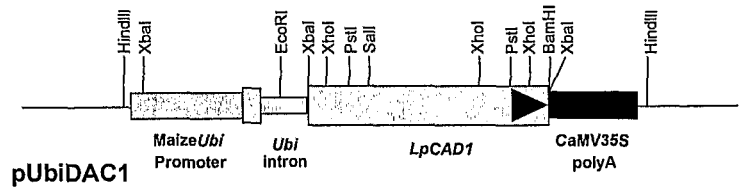
pUbiDAC1
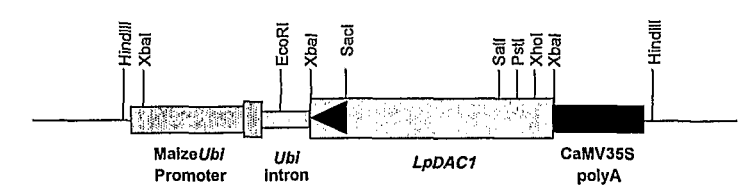

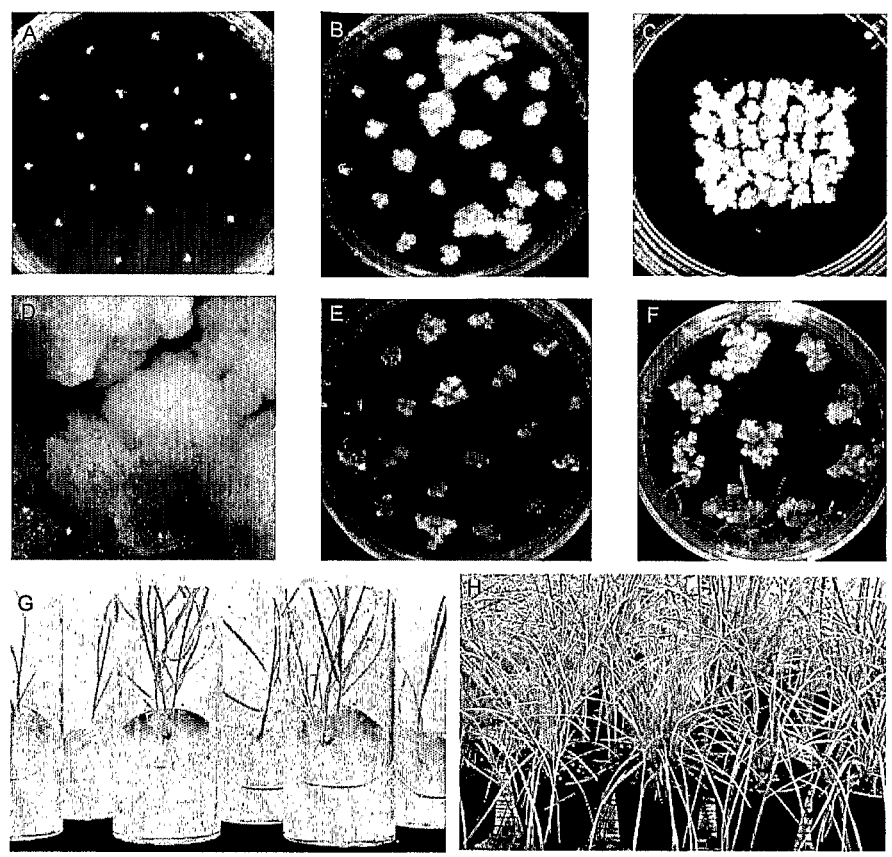
Figure 34A-H

```
        CGGGATCAACTTGGATGTCCTTTGCGGGCACGGTTTCAGGAACAACGACACATGCAGCAG
-2206   ------+---------+---------+---------+---------+---------+---   -2147

GGATCTCCTCCAAAGACTCACACAAAGGTGACATGAGCGCCCGCTTTTTTGAAGCCAAGT
-2146   ------+---------+---------+---------+---------+---------+---   -2087

TGGCTAAGAAATCGCAAAGCTTGGTGGAGTCGGCCACCTCAGGATCTGCAACAAAAGGCA
-2086   ------+---------+---------+---------+---------+---------+---   -2027

CCAAGGGAGCTGCCAACACATCAACCACAACATCATGTTCAAACGCAGTCTCCTCAAGCC
-2026   ------+---------+---------+---------+---------+---------+---   -1967

TCGAATGCTCAACCGAAAGAGAGGCAGAAGCTTCAACAAAAAACTCAGCCAACCCAAAGC
-1966   ------+---------+---------+---------+---------+---------+---   -1907

CCTCGACGTCATCAGAGATTAGGCTCTGAGGACCCGCAGGGAAGCAACCTTGTCAACAAC
-1906   ------+---------+---------+---------+---------+---------+---   -1847

CGCATCCGGCAGAAAAGGAGCAAGACCGGAGCAACCCTCAAGAGGCACACGAAAGACGTC
-1846   ------+---------+---------+---------+---------+---------+---   -1787

GAAGCCAAGAGGAGACGAGTCGCAGGGACGGCGGACAGGCGAGAAGGGGCCGTAGAACTC
-1786   ------+---------+---------+---------+---------+---------+---   -1727

CAAGAGCTCGGCGTCCCTCGACCTAGCATCCGAAGCACTGACCGGGGCACTCAATGCATA
-1726   ------+---------+---------+---------+---------+---------+---   -1667

ACTTTATCTTGATGGCATATGTACTCAAACCCATACAATGTTCACCATGCATTATCTATG
-1666   ------+---------+---------+---------+---------+---------+---   -1607

GAACATTCCTTCATATACAACTtCTGAGTGGTCAGTGCATAGGAATTTTCATTAACAACC
-1606   ------+---------+---------+---------+---------+---------+---   -1547

AAAAACATACTTGGGGCCTACACACACTTTCACAGCATGGAAAACTTGTTAGCTTTTTAA
-1546   ------+---------+---------+---------+---------+---------+---   -1487

AGAGTTGCAAAATCTGTCAAGCGAATGTTCTTGTGATAATTGGAACGAAGCATGTTTCCC
-1486   ------+---------+---------+---------+---------+---------+---   -1427

CATTTTCAATGTGTGTCTCTTACCCTAACTAGCACCCGACCAACAAAATCTGACCATCCT
-1426   ------+---------+---------+---------+---------+---------+---   -1367
```

FIGURE 38

```
        AGTTATATCATCATAGAGACCCACATGTAGGTTGACCCCCATAACACTTGTGTGGATATC
-1366   ------+---------+---------+---------+---------+---------+---   -1307

ATGGAAAATGGCCTTGATCAACACTTTCTTTCCTACTTGGTACAAATGGTTATGGACTTA
-1306   ------+---------+---------+---------+---------+---------+---   -1247

CTCAATTAGTGCTTTAGAGAGCTTTGGCTGCAGACTTTGTAGCTTCCCAATATTCATAGG
-1246   ------+---------+---------+---------+---------+---------+---   -1187

TCCCTCCGGAGTGGGCAGCCCCATCTACATAGGCTCAAAACCAGATTTTTGTAACATGTT
-1186   ------+---------+---------+---------+---------+---------+---   -1127

AGACACTTTCAACTTCATCATAGACCATCAAGGAGCTGGCATGTGACAGTGATATATGTA
-1126   ------+---------+---------+---------+---------+---------+---   -1067

TCAATTACCCATTCAACACGAATAGCTTGCTCATGCATGGTTAGTCTTGCGGCGGCGGGG
-1066   ------+---------+---------+---------+---------+---------+---   -1007

CGGGACCATCGAACACACCGCCGGGCGGTCAGTAGGCTAGGGTTAGATAAAATCTAGCCG
-1006   ------+---------+---------+---------+---------+---------+---    -947

TTTTCATTCAAACTTGTGATATATAATCAAATTTAAATAAAAACCTTTATTTTCGTGCAT
 -946   ------+---------+---------+---------+---------+---------+---    -887

TTTTATTTATTTGAGGGCGTGTTTGGGGGACACGGCTGGAAAGTGACATCCCCAAACACT
 -886   ------+---------+---------+---------+---------+---------+---    -827

GCACGAAGAAAACGCGTCGCCAAAAAATTCGATCCGGCGTCAGTCCTTTGGGAGACGATT
 -826   ------+---------+---------+---------+---------+---------+---    -767

TGGATGACGCGGCTAGAGATGCTCTAAGTTCTCCACGCCATGTTTCTTTCTATATATACA
 -766   ------+---------+---------+---------+---------+---------+---    -707

CACAGCCCAAGGTCCATGAAAAGTAAAACGGCACGACGACACGCACCGGCGACAACTTCA
 -706   ------+---------+---------+---------+---------+---------+---    -647

CATTACGGCACATCGCTATTACGGACCACATACAACTCCACCGCTATTCTCAGCCAAGTC
 -646   ------+---------+---------+---------+---------+---------+---    -587

ATACATGACATGATCCAATGGACGACTTTGTGAGCGAAACTAGAACCTTGCGGGGTTTAG
 -586   ------+---------+---------+---------+---------+---------+---    -527

ATTTTCCAATGTGGATAAGTTGTACGCGCCGACTAGCTTTACACTTGGTTGAAAAAAGCT
 -526   ------+---------+---------+---------+---------+---------+---    -467
```

FIGURE 38 CONTINUED

```
        TATTGTAGCACGACTTCTCACTGACATAGGAATGTAAACAGTCTCTCCACGCCATGTTTC
-466    ------+---------+---------+---------+---------+---------+---    -407

TTTCTAGTAGTAGCATACTAGTAGTAACTTCTCTTTGTCCTACACACACCCAGGGTCCAA
-406    ------+---------+---------+---------+---------+---------+---    -347

GAAAGGAAAACGGCACGACGGCACCCACCGACGACGACGACTCCACATCACGGTTCGGTA
-346    ------+---------+---------+---------+---------+---------+---    -287

AAAAAAGTCAAAACTCGCTGACGTGGCACCACCGGTCGCAGTCAACTGACGCGCTCCTCT
-286    ------+---------+---------+---------+---------+---------+---    -227

GCGCAGGTyTCACTtCAAGTTTCACCTACCACTGTGGGCCCACCGCCAaTGTGGGCCCCG
-226    ------+---------+---------+---------+---------+---------+---    -167

CGAGCTtCTtACTCACTGACCTGTCTCCCACCAGCCTCCTCGCCGGTATATTACCCCGGC
-166    ------+---------+---------+---------+---------+---------+---    -107

CCCCAATTTCCTCTGCCTTCCCACGAGCAGCAGCCGGAGCACGGAATCCCGGCCGCCATT
-106    ------+---------+---------+---------+---------+---------+---     -47

CCTCCACCTTCAGCTCCGCCCAAAGATTTCCATCCGGCGAGATCCATGGGCTCCATCGCG
 -46    ------+---------+---------+---------+---------+---------+---      13
                                                          M  G  S  I  A

GCGGACGCGCCTCCCGCGGAGCTGGTGTTCCGGTCCAAGCTCCCGGACATCGAGATCCCG
  14    ------+---------+---------+---------+---------+---------+---      73
         A  D  A  P  P  A  E  L  V  F  R  S  K  L  P  D  I  E  I  P

ACCCACCTGACGCTGCAGGACTACTGCTTCCAGCGCCTGCCGGAGCTCTCCGCGCGCGCC
  74    ------+---------+---------+---------+---------+---------+---     133
         T  H  L  T  L  Q  D  Y  C  F  Q  R  L  P  E  L  S  A  R  A

TGCCTCATCGACGGCGCCACGGGCGCCGCGCTCACCTACGCCGACGTGGACGCCCTCACG
 134    ------+---------+---------+---------+---------+---------+---     193
         C  L  I  D  G  A  T  G  A  A  L  T  Y  A  D  V  D  A  L  T

CGCCGCTGCGCCGCGGGCCTCCGCCGCCTGGGGGTCCGCAAGGGCGACGTCGTCATGGCG
 194    ------+---------+---------+---------+---------+---------+---     253
         R  R  C  A  A  G  L  R  R  L  G  V  R  K  G  D  V  V  M  A

CTGCTCCGCAACTGCCCCGAGTTCGCCTTCGTGTTCCTCGGCGCCGCCCGGCTCGGCGCC
 254    ------+---------+---------+---------+---------+---------+---     313
         L  L  R  N  C  P  E  F  A  F  V  F  L  G  A  A  R  L  G  A
```

FIGURE 38 CONTINUED

```
      GCCACCACCACCGCCAACCCGTTCTACACGCCCCACGAGATCCACCGCCAGGCGACCGCC
314   -----+---------+---------+---------+---------+---------+---   373
      A  T  T  T  A  N  P  F  Y  T  P  H  E  I  H  R  Q  A  T  A

GCCGGGGCCAGGGTCATCGTCACCGAGGCCTGCGCCGTCGAGAAGGTGCGCGCCTTCGCC
374   -----+---------+---------+---------+---------+---------+---   433
      A  G  A  R  V  I  V  T  E  A  C  A  V  E  K  V  R  A  F  A

GCCGAGAGAG
434   -----+---   443
      A  E  R
```

FIGURE 38 CONTINUED

```
          TCGACGCGGCCGCGTAATACGACTCACTATAGGGCGAAGAATTCGGATCATATGGATTCG
-6735     -----+---------+---------+---------+---------+---------+----     -6676

ACACTGGAATTTACTCCCATCGGGAGCGTGCAAACAAAAAGGTGTTATAGCAAGAAGACA
-6675     -----+---------+---------+---------+---------+---------+----     -6616

CTGGCAACATTGCCAGCACAGAATTTGTTACAATCATAGAAAGTTTTATGACAGGACATT
-6615     -----+---------+---------+---------+---------+---------+----     -6556

GTTTCAACCGAAAGCAAGATTACAACAATATAATCAAGGGCTTGGGTCTGGTTGGACATG
-6555     -----+---------+---------+---------+---------+---------+----     -6496

CTCGGTCCAATGGACGATTTATTTGCCGAGACCAGCTCAAGGAGTTGACGAGCACACTTA
-6495     -----+---------+---------+---------+---------+---------+----     -6436

AGCGCCGAGATCTTAAAGGCACCCAAGTCAACAAGTCGCCCATCTTGCTCTTTTGGCAGC
-6435     -----+---------+---------+---------+---------+---------+----     -6376

TCCTTGGACATCTCTTCGATATTGGCTTTGAAGCCATGACCCATCATAAGCTGAAAGGCT
-6375     -----+---------+---------+---------+---------+---------+----     -6316

AGGAGGGCACCATAGGTACGCGAAGTACGTTTGAATACCTCGAGGACCTCCCTCGTGTTG
-6315     -----+---------+---------+---------+---------+---------+----     -6256

ATGGCGAAAGCATCGATCAGCTGCCCCAAGGTCTTGTTTTGATCGATCTTGGGGAAGATC
-6255     -----+---------+---------+---------+---------+---------+----     -6196

ATCGAGTGCATCCGCGTCATGGATCCTTTACCCTTCTGAAGGAGGTCCTGAAAAAGCTGG
-6195     -----+---------+---------+---------+---------+---------+----     -6136

TGAGACCCGAGGGTCATTGACAAAGCATTCGCCGGAGAATTATTCGGCAATTTATCTAGA
-6135     -----+---------+---------+---------+---------+---------+----     -6076

GCCTCAGCAGGGATGTAGGCAGCTTCTGGAGAAAGTGAAAGAGGAGGAGCTCACTAACCA
-6075     -----+---------+---------+---------+---------+---------+----     -6016

AAATCAAATCGATAAAGCAAAAATCGGAAAGGAGGCCAAAAGGGGATTACTGAGCAAGGC
-6015     -----+---------+---------+---------+---------+---------+----     -5956

CAAGGAAGATTGGCGAAGGAGCTCATCTTTTTCAATCGCCCGAGCTTCGGCAGCAAGCCT
-5955     -----+---------+---------+---------+---------+---------+----     -5896

GGATGCCTCTTCATCCTTCAGCCTCTTTCTTAGCCCCTCGAGCTCATCCTTAAAGGAATC
-5895     -----+---------+---------+---------+---------+---------+----     -5836

AACCTCCTGGCGGGCCTCGGCAGCTATCTTTATCGCACCCTCCAGCTTCGAGGAAGAAGA
-5835     -----+---------+---------+---------+---------+---------+----     -5776

CTCGACCTCCTTTTGCAGCCGAGTCTTGTCAACTTCCAGAGAAGTGTATTGGGAGGCGAA
-5775     -----+---------+---------+---------+---------+---------+----     -5716

GGCCTCCAGAGAAGAGATAACAGCTCACAAATCCTTAAGAGATAAGGAAAAATAATTAGA
-5715     -----+---------+---------+---------+---------+---------+----     -5656

CGAAGAACTGGTTGTCAACAAACTTATAATTTGATCAGGGAAATCGTCCCACATGGATAT
-5655     -----+---------+---------+---------+---------+---------+----     -5596

ATCGTTAAAACAGGAAAAGCTTACAGGTTTCCCTGGAGGAGAAGCTGTAACCACGGCAGT
-5595     -----+---------+---------+---------+---------+---------+----     -5536
```

FIGURE 39

```
            CAAAGAAATCTCCTTCCCTTTGGAAAGGGAAGAAGTTGTCGATATTTGAGCCATGGGGGC
    -5535   -----+---------+---------+---------+---------+---------+----   -5476

TGCGGCAGGAGTCGAAGCCTCGGAAGCGGCTGGATTCGGCACGATGGCACCAGATTTGGC
    -5475   -----+---------+---------+---------+---------+---------+----   -5416

CTTCTTGGCCGGAGGCTCGATGAAGCCATCTTCACTGCAAGAACAAAAAACTAGCGAAGT
    -5415   -----+---------+---------+---------+---------+---------+----   -5356

CAGAATTCAATGCATATGGCGAAGTTAGAACACAATCCTGGAAAAGGAAGCAAGGACTTA
    -5355   -----+---------+---------+---------+---------+---------+----   -5296

CAATTCATAGAGACCATCTTCATCGGCAAAGCCGCCGGATGATCTCTTTGGAGGTAGTGC
    -5295   -----+---------+---------+---------+---------+---------+----   -5236

CTCGGCCTTTTCCGTAGCTGCATCAACAAAGGCAGCACGATCAGCATCGTCATCATGCAT
    -5235   -----+---------+---------+---------+---------+---------+----   -5176

TGACCCCGCTGTATCGCTCATATCATCGGCAGAGAATCGAGGATTGATGGAAAAAGCCTC
    -5175   -----+---------+---------+---------+---------+---------+----   -5116

AGGATTCATCGGATCATCATGTTGATCTATCGGGCTTGCATTCCCTAGAGTATGGGACCC
    -5115   -----+---------+---------+---------+---------+---------+----   -5056

TACAAGGACTAAGGAATCCCTTTTCTTGGAAAAATTGTTCGACAGGTCTTGCAAACGTTC
    -5055   -----+---------+---------+---------+---------+---------+----   -4996

AAGAGCCGTAAGGATCTGTCGTAGTTGACGAGTGAGAATAATGGCAGTTAAAATAATCAA
    -4995   -----+---------+---------+---------+---------+---------+----   -4936

AGGAACATGACAATAAGAGCATAAAGGGGAAATTTACCTCGGTTGGCAGATGACCAGCGT
    -4935   -----+---------+---------+---------+---------+---------+----   -4876

CAAATGGCGGTTGAGGAGATATCAGTGGAATTGAATCTTCCTGGCTAAAGAGGGTGAGAC
    -4875   -----+---------+---------+---------+---------+---------+----   -4816

ACCGGACTTCGTCAAGCAGTTCTTTTTCGGATAATTCAGCAATATTTACTCTAGTCTCGT
    -4815   -----+---------+---------+---------+---------+---------+----   -4756

CCCTGGGACCCGAATACAACCACATCGGATGGGTCCTAGACATGATCGGCTGAACTCGAT
    -4755   -----+---------+---------+---------+---------+---------+----   -4696

GTTTTAAGAACACAGCGGCTACCTCAGTACCTATCATGGTTTGACCATCGGATTCTTTGA
    -4695   -----+---------+---------+---------+---------+---------+----   -4636

TCCGAAGGAATCTATCAAATAACTTGTCTACTGTTGGTTTTTCATCGGGTGAGAGGATAT
    -4635   -----+---------+---------+---------+---------+---------+----   -4576

TTTTCCAAGACTTCTTGGGCTTGCTTCTAGAACATCGGAGAATTGGGGGGAGCTGGGAG
    -4575   -----+---------+---------+---------+---------+---------+----   -4516

TCGGCTGCTGATGAGTCCTTAATATAAAACCACTTCAGCCTCCAGCCTTGCACGGATTCT
    -4515   -----+---------+---------+---------+---------+---------+----   -4456

TTCATCGGGAAGTTGAAGTAGTTGACTTCCTTACGAGCAACAAAACCAACCCCACCAATG
    -4455   -----+---------+---------+---------+---------+---------+----   -4396
```

FIGURE 39 CONTINUED

```
       ACGAAGGACCCACCACTGCTGTTATATCTTTTCACGAAGAAAATCTTCTTCCACAAACCA
-4395  -----+---------+---------+---------+---------+---------+----  -4336

AAGTGGGGCTCAATGCCCAAAAACGCTTCGCAGAGGGTGATAAAGATGGCAAGGTGAAGG
-4335  -----+---------+---------+---------+---------+---------+----  -4276

ATTGAGTTGGGGGTTAACTTCCATAATTGAATCTCATACACTCGAAGGAGGTGGTGAAGA
-4275  -----+---------+---------+---------+---------+---------+----  -4216

AATTTGTGAGCGGGAAGCGAAAGACCTCGGTACAAGAAGGATAAGAACATCACAGTAAAA
-4215  -----+---------+---------+---------+---------+---------+----  -4156

CCGGCAGGAGGATTGGGCCGTGAAATTGCACCTGGAAGAATAACATTCCCCTCGTCAGAA
-4155  -----+---------+---------+---------+---------+---------+----  -4096

GAAATTATTACGAGGCTCCGGGCCCTCTTTTCATCTCGCTTCGTGGTGGTAGAAGCTGGC
-4095  -----+---------+---------+---------+---------+---------+----  -4036

CAATCGCCAGGGATAGGCCCGGCCGTGGAGCTTGACGGCGCTGGCGGTGCCGGAGCTGAG
-4035  -----+---------+---------+---------+---------+---------+----  -3976

GGAGGAGCATCTGGCGCGCTTCTCCGCGGCGGATTCGAAGGAGCCCTGACGGTGGTGCCA
-3975  -----+---------+---------+---------+---------+---------+----  -3916

CTGCTCACGGCGCTGGTGGCGAGAGTGGGATTCTTCTTCTTCACCATTGTGAGATTTGAG
-3915  -----+---------+---------+---------+---------+---------+----  -3856

GGAGATCTGGGAGTTGCGACGGTGGCGTGGTAGTTGCAAACGAAAAGGATGAATGAGGAA
-3855  -----+---------+---------+---------+---------+---------+----  -3796

GAAGGGACGCAAGGATGAAGTGTGGAAAGGGGAGTTTACCCCAAGAGATTATAAAGTGAA
-3795  -----+---------+---------+---------+---------+---------+----  -3736

AGGAAAACCTGAGAATTGAGCGGGCACGTGTCGTTGCTCTCAATTTATTGAGGGGATTTT
-3735  -----+---------+---------+---------+---------+---------+----  -3676

TTCTCATCATAGATCGCGGAAATCGAGGAGTCACCTTGGTAACTGCACGCAAGTAGTGGT
-3675  -----+---------+---------+---------+---------+---------+----  -3616

CATTTCTTAAACAGAACCGCATAGAAGTAGGATGGGACCGTCAGGTCACGTCCTATCAGT
-3615  -----+---------+---------+---------+---------+---------+----  -3556

CAGATTTACAACAGTAATTACATCATCACTGACGTCAAAGTATGCTTGAAGTATCCGAAG
-3555  -----+---------+---------+---------+---------+---------+----  -3496

AAAAGTCGAAATTTGGGCTCGAAGACTTTCTTGCAGAGAAGCGCGTGAAAGGAATATCTA
-3495  -----+---------+---------+---------+---------+---------+----  -3436

AGGAAAGGGTCAAAACATTCGGCTCGAGTCTACGCACGGATTGCAAGCATCCGTACCTAG
-3435  -----+---------+---------+---------+---------+---------+----  -3376

ACTCGGGGGCTACTCCCATCGGGAGCGCTGGACGTGCACCCGATAAATTTAGACGAGGAT
-3375  -----+---------+---------+---------+---------+---------+----  -3316

GAAAACCGGAAACCCAAGTGCTACTCCCATCGGGAGCGCCGATTACGCACCCGACAAACT
-3315  -----+---------+---------+---------+---------+---------+----  -3256

TTTTTGCACTCCAGGATCATGCCCGGGGACTTAATTCTGTGTAGAGTAGCGTTGTTTTGT
-3255  -----+---------+---------+---------+---------+---------+----  -3196
```

FIGURE 39 CONTINUED

```
            CTTCGGCAGTTAACCAGCAAAGCTGGACACGTTACTCAATATCCTTTACGCATTAAACCC
-3195       -----+---------+---------+---------+---------+---------+----      -3136

TTACTTGAAGAATTGAAGCCCCGATGCAAATATATCGGATGACCTATGAAGGCCTGCGGA
-3135       -----+---------+---------+---------+---------+---------+----      -3076

AAGCTTCGGGAGAAGAAGACATTCGAGTGGCACAACTTGAGTCTACGAACGGATTGCAAG
-3075       -----+---------+---------+---------+---------+---------+----      -3016

CATCCGTACCTAGACTCGGGGGCTACTCCCATCGGGAGCGCTGGACTCGCACCCGATAGA
-3015       -----+---------+---------+---------+---------+---------+----      -2956

AGGAGATGATGATATTACAAGAAGGACAAGAAGTATCAAGGGAGAAGAACATTCGGTGGA
-2955       -----+---------+---------+---------+---------+---------+----      -2896

GGCATGCTTTAGTCTCTACCCGAAAAAACTTCGGCTAGACACTCGGGGGGCTACTGACGT
-2895       -----+---------+---------+---------+---------+---------+----      -2836

GGGCATTACCCTTCGGGTAACTGATATTGCCCTATCCTGTACGACCCAACTGGAGGCCCA
-2835       -----+---------+---------+---------+---------+---------+----      -2776

TGAAGACACTCGAAGGCAAGGTGGACCACTACGTCGGTGCCGAAGGGGGTTCCTTGAAGA
-2775       -----+---------+---------+---------+---------+---------+----      -2716

ACAAGACGAAGAAAAGAAGAATACAAGAAAAGTATAGAACTAGGATCTTTTGTAACCTGG
-2715       -----+---------+---------+---------+---------+---------+----      -2656

TCGTACCCGGACAGATCTCTCGAGACCTGGCCCCCTACATATGGGCTAGGAGAGGGGCTG
-2655       -----+---------+---------+---------+---------+---------+----      -2596

CCGAGAGGGACACACACAATCTTAGCAATTTTAGCCACCATAAGTCCAGAGCAAGGTCCC
-2595       -----+---------+---------+---------+---------+---------+----      -2536

CGTAGAACTTAGCCTCTCGACGAGATCACAGCCGAAACCTTCGGCACCCCATTGTAACCC
-2535       -----+---------+---------+---------+---------+---------+----      -2476

GATATTTTCATAGTCAAGATCAGACAGGTAGGACGTAAGGGTTTTACCTCATCGAGGGCC
-2475       -----+---------+---------+---------+---------+---------+----      -2416

CCGAACCTGGGTAAATCGCTCTCCCCGCTTGTTTGATAACCGATGGCTTGTGTCAGCTTA
-2415       -----+---------+---------+---------+---------+---------+----      -2356

CATGATTCCATCTACCCTAAACCTCAAACGGAGGGCATTGCCGAGGAGTACCCTCGACAT
-2355       -----+---------+---------+---------+---------+---------+----      -2296

TCCCCTCCACCAATGGTCTCACATAAATTCAACAAAGCAAACTCATAAAAAGTTTAATGA
-2295       -----+---------+---------+---------+---------+---------+----      -2236

GTTTCAGAAAGAAATAAAACTAGGCCCCTCCTTTGAGAATCTACGAATGATTCACCATAT
-2235       -----+---------+---------+---------+---------+---------+----      -2176

CATCTCGCAGTTAGTGATGAGTAACTAAGTCTCAAATTTCCCGACGCATGGCGAAAAGG
-2175       -----+---------+---------+---------+---------+---------+----      -2116

TAGCGAACTTAAAATGTGAGGAATGAATGCCACATATGCATGGTGCATCGAGTATTCTCA
-2115       -----+---------+---------+---------+---------+---------+----      -2056

TTTTAGTCTTGGATTACTCCCTTTAGATGTTGACACCATCCCAAAAATACAACTTGGACA
-2055       -----+---------+---------+---------+---------+---------+----      -1996
```

FIGURE 39 CONTINUED

```
        AGTTGTTCATTTCACTAGTATGAATTTCAGTAAATCGGGCAATACTCCAACACTCATTCA
-1995   -----+---------+---------+---------+---------+---------+----   -1936

CCCCCTAGGCGAGGTTAGCTCAGATCAACGTCGGGTGTCTTCATCGAGTTAATGTCGTCA
-1935   -----+---------+---------+---------+---------+---------+----   -1876

CACGCACACACACGTACGCGCACACACACGTGCGCAAACAAAAAGAAAACTAGGAACCTT
-1875   -----+---------+---------+---------+---------+---------+----   -1816

CTCACGTAGCCTAGGTCTTGTCCTGTAAGAAAAAACCCAGGTCCACCCTAGTTTCGAACC
-1815   -----+---------+---------+---------+---------+---------+----   -1756

AAAATATTTTTGAAGATACATTAGTAAGATATTTTTGAAAATAAAACCGCAAAAAGGGAA
-1755   -----+---------+---------+---------+---------+---------+----   -1696

TTGAAAAATATGGACTGGCTGTTTTGTCCAAAACCACATCTTTCGGAGAACCACGAGGGT
-1695   -----+---------+---------+---------+---------+---------+----   -1636

ATCTATTGATGGGCTCATACTATACCTGGGCATGTGTTGGGCCAGGCCTCATGTCGGGCC
-1635   -----+---------+---------+---------+---------+---------+----   -1576

GAGGAAAGCCCGACGCTGAAAAATCAGGCCCAAGCTTAACCCGGCCCGACCAAATACCCA
-1575   -----+---------+---------+---------+---------+---------+----   -1516

CCAAACCCGTTGGGCCATCAGGTTGCGGGCCGGGCAGTAGTGTAAAACACCGATTTCGGG
-1515   -----+---------+---------+---------+---------+---------+----   -1456

CTACATAGGCCCGGCTCGTTTGTCGGGCAAACATTTCTAGACCTAAGCCCGAGTTTTTCG
-1455   -----+---------+---------+---------+---------+---------+----   -1396

GGCCGGGCTGCCCATGGCCAGGTATAGCTCATAACGACGTATGACATTTCGAGCAATTGA
-1395   -----+---------+---------+---------+---------+---------+----   -1336

TGCAAAGCACGTGTAGGGTTTTATCCCATCCGTGTGGCGTGTGTAGGGTGTAAATGAATA
-1335   -----+---------+---------+---------+---------+---------+----   -1276

GGATAATTTCCTCGCCGAAACTGGTCCCAAATTCGCTTTGAAGTGTCCATATATGATTTT
-1275   -----+---------+---------+---------+---------+---------+----   -1216

AAAGAATGTGACAAATAAAGATATCCAATTTCGAAATAGTGCTCCGGATACGGTATAGGA
-1215   -----+---------+---------+---------+---------+---------+----   -1156

TATGGTATAGCAAATAACATGCTGATATGGATTGTCCGATATTAAATTAAGATAATCCAA
-1155   -----+---------+---------+---------+---------+---------+----   -1096

ATGTTTTAAACCGCATAATTCGATTTTTGAGTCAAAAGCGAATGCCAATTCAGAAGGTTA
-1095   -----+---------+---------+---------+---------+---------+----   -1036

GCAGTTATTGAGTTTCAAAATTTATTTGGCGAGCATATCTAGTTCTAAATTCTATCACGT
-1035   -----+---------+---------+---------+---------+---------+----   -976

AAATTGTGTCTTTTTTTAATAACTACACAAGACTAAAAGTTTAAATCTCTCTCAAGATTT
-975    -----+---------+---------+---------+---------+---------+----   -916

GCGAAAACTATAGCTATCTACTGATATATATATCCGACTATATTTGTTTTCGGACCGCAT
-915    -----+---------+---------+---------+---------+---------+----   -856

GCGTCCTATTTCCGATTCGAATCTGCACTCCGATATATCCACATTGAATCTAAAACCGAT
-855    -----+---------+---------+---------+---------+---------+----   -796
```

FIGURE 39 CONTINUED

```
-795  CAATATTTGCTCCGATCTAAATCCGGAAAAATATGTGGTGAAGGATATGGTATAAGCAAA  -736
      -----+---------+---------+---------+---------+---------+----

-735  ATCCGATTTGATCCATTTGTACCTCTAGGCGTGTGCAAGACCTGGAGGAAAGAATGGCGC  -676
      -----+---------+---------+---------+---------+---------+----

-675  ATCTGTAGGGTGCAGTCCCACCGGTGGAAAATGTGAGCTCACCGTATTGTCCCCCGATGG  -616
      -----+---------+---------+---------+---------+---------+----

-615  AGCATCGAAACGGAGTCGGAACACGATTTGCGCCACGTACAGAGCATGCATGATTTCCCT  -556
      -----+---------+---------+---------+---------+---------+----

-555  TGTATGCGGTCCAGGATCTTAAACTGCCTTCCATTTCCAGGAACCTACCGATTGGCTGCA  -496
      -----+---------+---------+---------+---------+---------+----

-495  AGCCGTAGCTAGCGGTTTGAAGTCACGGCATTGCCGCCCCGATTAACCCACCCGTCGCG  -436
      -----+---------+---------+---------+---------+---------+----

-435  CGCGCGGTCGGTCGTTTCACCGTCCTGCCTAGGCTACGCACGCGCGCGCGCAGTTGGGCC  -376
      -----+---------+---------+---------+---------+---------+----

-375  AGTTGTAGGTAAGCCGACTCGAGATCACACACCCGGCCTCACCTACTACCTCTCGCCGTC  -316
      -----+---------+---------+---------+---------+---------+----

-315  GCGGTCACCGTGTCACACTCACGCCCAGGGGAGCCACCCGCCCACACGGCGCCTAGCTCA  -256
      -----+---------+---------+---------+---------+---------+----

-255  TCCCCTCTCACTACTCTTCTTCTCCTCCCTCTCACCTCGCCGTCGACCCAGCTCCCGGCT  -196
      -----+---------+---------+---------+---------+---------+----

-195  CTATAAATTCCGCACTACTCGAACCAACATCGCCCAGGCCTTTGCCTTTTACGACGAATC  -136
      -----+---------+---------+---------+---------+---------+----

-135  CTACCAAACCGAGCTACCAGATCCTTCTCTACTAATCGAGCTCCCTACGCTGCTCCGCCT  -76
      -----+---------+---------+---------+---------+---------+----

-75   GTCTTCGTTTCCGCCTCACCGCCGGCCGGTTCTCCGCTCCAAGCTACGTCCGTCCGTCCA  -16
      -----+---------+---------+---------+---------+---------+----

-15   CATATATAGCATCGACATGACCATCGCCGAGGTCGTGGCTGCCGGAGACACCGCCGCCGC  44
      -----+---------+---------+---------+---------+---------+----
                    M  T  I  A  E  V  V  A  A  G  D  T  A  A  A

45    GGTGGTGCAGCCCGCCGGGAACGGGCAGACCGTGTGCGTGACCGGCGCCGCCGGGTACAT  104
      -----+---------+---------+---------+---------+---------+----
      V  V  Q  P  A  G  N  G  Q  T  V  C  V  T  G  A  A  G  Y  I

105   CGCGTCGTGGCTCGTCAAGCTGCTGCTGGAGAAGGGGTACACCGTCAAGGGCACCGTCAG  164
      -----+---------+---------+---------+---------+---------+----
      A  S  W  L  V  K  L  L  L  E  K  G  Y  T  V  K  G  T  V  R

165   GAACCCAGGCATGTCACCCATGCATTCATCATTTTCTTACTAGTCGTATGCGTTATGCGA  224
      -----+---------+---------+---------+---------+---------+----
      N  P  G

225   CTTGTGTATTAACTATTGTGGACTGCATGCAGACGACCCGAAGAACGCGCACCTGAGGGC  284
      -----+---------+---------+---------+---------+---------+----
                              D  P  K  N  A  H  L  R  A
```

FIGURE 39 CONTINUED

```
       GCTCGACGGCGCCGCCGACCGGCTGGTCCTCTGCAAGGCCGACCTCCTCGACTACGACGC
285    -----+---------+---------+---------+---------+---------+----    344
        L  D  G  A  A  D  R  L  V  L  C  K  A  D  L  L  D  Y  D  A

CATCCGCCGCGCCATCGACGGCTGCCACGGCGTCTTCCACACCGCGTCCCCCGTCACCGA
345    -----+---------+---------+---------+---------+---------+----    404
        I  R  R  A  I  D  G  C  H  G  V  F  H  T  A  S  P  V  T  D

CGACCCCGTACGTACTCCATAGAACTCGGCACCCCTAGCTTCTCTCCGTTCTCTCTGTAT
405    -----+---------+---------+---------+---------+---------+----    464
        D  P

GTCTGTCACCGTCGATCGCCATGGCAGCACGCATGCATGCGCGCGCAACGCTAGCTAGAC
465    -----+---------+---------+---------+---------+---------+----    524

GCTGACCGACTCATTGTGCAGGAGCAAATGGTGGAGCCGGCGGTGAGGGGCACGCAGTAC
525    -----+---------+---------+---------+---------+---------+----    584
                          E  Q  M  V  E  P  A  V  R  G  T  Q  Y

GTCATAGACGCGGCGGCGGAGGCCGGCACGGTGCGGCGGATGGTGCTCACCTCCTCCATC
585    -----+---------+---------+---------+---------+---------+----    644
        V  I  D  A  A  A  E  A  G  T  V  R  R  M  V  L  T  S  S  I

GGCGCCGTCACCATGGACCCCAACCGCGGGCCGGACGTGGTCGTCGACGAGTCGTGCTGG
645    -----+---------+---------+---------+---------+---------+----    704
        G  A  V  T  M  D  P  N  R  G  P  D  V  V  V  D  E  S  C  W

AGCGACCTCGACTTCTGCAAGAAAACCAGGGTGGGTGCTGCATGCTCAATTTTTATTATC
705    -----+---------+---------+---------+---------+---------+----    764
        S  D  L  D  F  C  K  K  T  R

ATAGCTACCCTTTTTCTGCACCATGCTGCATTTCTTTTCCAAAAACAACTCTCAAAAGAT
765    -----+---------+---------+---------+---------+---------+----    824

ATGCTACGTGGTGAGTTCCTATAGCTGAATTATTACAACTACCACCCTATCGATCACTAC
825    -----+---------+---------+---------+---------+---------+----    884

CGCCCTAAAAGTGTTCAACTTTTGAAGGCAACCAAAACCAATACATGAACGACGATCGTG
885    -----+---------+---------+---------+---------+---------+----    944

TGCGCTTGTCGTCGTTATCATTAGCCTCTGTAGCTCTAATTTTCACCTATGTACGCATGG
945    -----+---------+---------+---------+---------+---------+----    1004

ATAGACGATTCGGAAATACAGTTCAGTTTACCTACCATATACTATGCCGAAATCGAACGC
1005   -----+---------+---------+---------+---------+---------+----    1064

ACACAGGTGTGAGGCAGCAGCCGCTCACGAGTTATGCGCCGAAACCGACATCTCGGAATC
1065   -----+---------+---------+---------+---------+---------+----    1124

TTCAGTCCACAATCAAAAAATAGACACCTGGTACCACTACAAAATTATACTCCTACTGTA
1125   -----+---------+---------+---------+---------+---------+----    1184

TATTGGTAAAACAAAACATTTTCTTTTTTATTTGATAGGAGTGCTGCAAATTAAAGTTCT
1185   -----+---------+---------+---------+---------+---------+----    1244

TTGTGTCATTTTTCAAAGGAAAAAAAAAACACCTTTACCACTCTTCTTCCTTGCCATCAT
1245   -----+---------+---------+---------+---------+---------+----    1304
```

FIGURE 39 CONTINUED

```
     TTTTTTTTTACCAAAGTTTGTTCTGTCAAATGAACATATATATAGTTCGGTGCTATGTCA
1305 -----+---------+---------+---------+---------+---------+----  1364

GTGCCATTTACCGGCCACTAGCTAGTAGGACTGCCATGTTCCAGCAAATTGTCTAGTGGA
1365 -----+---------+---------+---------+---------+---------+----  1424

CCGGAGTGGCCAAAAGGAGCCAATTATGTAGGGTTGCAAGCGGGATCACACAAAAGCCTC
1425 -----+---------+---------+---------+---------+---------+----  1484

GCCTCTAGTTCATTTTATCAATTAAGTGGTACTTTCTCAGGGACCCCCCTTGCAACTCTA
1485 -----+---------+---------+---------+---------+---------+----  1544

CCATTACATCCGTGCAAAATAAAAGCTAGCATCACGCACCAGATTTAGTACTCCCTCCGT
1545 -----+---------+---------+---------+---------+---------+----  1604

TTTTATTTAGTTCGCATTCTAGGTTCAGCCAAAGTCATACTTTGCAAAGTTTAACCAAAA
1605 -----+---------+---------+---------+---------+---------+----  1664

TTATAAGAAAAAAATATCAATAATCATCATACAAAATACATATAATATAAGAGTAAACCT
1665 -----+---------+---------+---------+---------+---------+----  1724

TATAACGATTCTACAATAGATTTTTTTATTGCATATGTCAATATTTTTTCATAAATATTT
1725 -----+---------+---------+---------+---------+---------+----  1784

ACTCAAAATTATAAGGTTTGACTTTGACTAAACCCAGAACCTTCTTAGAGAGGAAGAAAT
1785 -----+---------+---------+---------+---------+---------+----  1844

GCATGGGCAAAAGCAAATCATGCATATGGGCAGGAGTAACATTTTTTTGACTTTCATAGA
1845 -----+---------+---------+---------+---------+---------+----  1904

AAGTACTGTATGGCACTAAACGGTCTAAACCGGACACTGGAAGCAAATCGTGCACGTGGG
1905 -----+---------+---------+---------+---------+---------+----  1964

CAATATTATCTACCGTCGCGTCGCCAGTCTCCCCATGCCCATGACCATGCTTGGAATTTT
1965 -----+---------+---------+---------+---------+---------+----  2024

AGTCTCGCCGGAGCTGCCGAGTGCATGCATAGTGACGAGTTTCAATAGGCCACTATATAT
2025 -----+---------+---------+---------+---------+---------+----  2084

GTGATCATGGCTCTTGATTTGTCACTTTCTTTTTTTGCCGAAGGATATAGTAGTATTACT
2085 -----+---------+---------+---------+---------+---------+----  2144

TTCTCTGCTATCACAAAGAAAGAACTGATTGTGTCTAGTCTAGGTGGTCTCAGAATTCTG
2145 -----+---------+---------+---------+---------+---------+----  2204

CATGACTCCAGAGTATTCTTGATGCCACTTGTTTGTTATTGCAAGAAACTTAATTCGGAG
2205 -----+---------+---------+---------+---------+---------+----  2264

ACAACCAAAAGCTCATCCCATGTCTCTGGAACTAGTAGACATAAGAAAATCTCATGGTAT
2265 -----+---------+---------+---------+---------+---------+----  2324

CAGTTTGCTATTTATCTACAACTGAAACGGCATGTTTGGTTTTATTAAATTCAGAACTGG
2325 -----+---------+---------+---------+---------+---------+----  2384
                                                               N  W

TACTGCTACGGGAAGGCGGTTGCGGAGCAGGCGGCATCGGAGTTGGCGCGGCAGCGCGGC
2385 -----+---------+---------+---------+---------+---------+----  2444
      Y  C  Y  G  K  A  V  A  E  Q  A  A  S  E  L  A  R  Q  R  G
```

FIGURE 39 CONTINUED

```
       GTGGACCTTGTGGTGGTGAACCCGGTGCTGGTGATCGGCCCCCTGCTGCAGCCGACGGTG
2445   -----+---------+---------+---------+---------+---------+----   2504
       V  D  L  V  V  V  N  P  V  L  V  I  G  P  L  L  Q  P  T  V

AACGCCAGCATCGGCCACATCCTCAAGTACCTGGACGGGTCGGCCAGCAAGTTCGCCAAC
2505   -----+---------+---------+---------+---------+---------+----   2564
       N  A  S  I  G  H  I  L  K  Y  L  D  G  S  A  S  K  F  A  N

GCCGTGCAGGCGTACGTGGACGTCCGCGACGTGGCCGACGCCCACCTCCGCGTCTTCGAG
2565   -----+---------+---------+---------+---------+---------+----   2624
       A  V  Q  A  Y  V  D  V  R  D  V  A  D  A  H  L  R  V  F  E

TGCGCCGCCGCGTCCGGCCGCCACCTCTGCGCCGAGCGCGTCCTCCACCGCGAGGACGTC
2625   -----+---------+---------+---------+---------+---------+----   2684
       C  A  A  A  S  G  R  H  L  C  A  E  R  V  L  H  R  E  D  V

GTGCGCATCCTCGCCAAGCTCTTCCCCGAGTACCCCGTCCCCACCAGGTACGCGTACGAC
2685   -----+---------+---------+---------+---------+---------+----   2744
       V  R  I  L  A  K  L  F  P  E  Y  P  V  P  T  R

CTGCTTGCTAGCCGCTTCCGTTAATTCCATTGCCTTAATTGATTGCATGATGCCGCTCCT
2745   -----+---------+---------+---------+---------+---------+----   2804

AATTTACTCACTTGCGTAACTAATTGCATTCATATATGATCTACCAACCGTGGAGAAAAT
2805   -----+---------+---------+---------+---------+---------+----   2864

TAGCAAGAGTCTGTCGGGGCGTCCCGGTCCAGTGCAGTTAACCTGCATGTCGATGGTCTG
2865   -----+---------+---------+---------+---------+---------+----   2924

CAGGTTGCAGCTTACTTGTGGTTCTTTAGTTCAGAGACACAGAGCAATTGGGCACTAAGC
2925   -----+---------+---------+---------+---------+---------+----   2984

AAAACTGACATCACTGGTAATTAGGTAGCTCCCACACACTGAAGTGGGTGGATCCCATCG
2985   -----+---------+---------+---------+---------+---------+----   3044

GTAGTAGGTAAGGGTGGATAGTACTGGACGAGAGCTCGATCGTTGTTGTAAAAAAGCGAG
3045   -----+---------+---------+---------+---------+---------+----   3104

TGACCACCACTTCACCATCCACTGCAAGTAGCTGCTAGTGAACCATCCAACCAGCTCCCT
3105   -----+---------+---------+---------+---------+---------+----   3164

GGATCACTCTGCTCCGTCCGTACCTTCAGCTACCTACAGAAGCGACATGAACACACAGAC
3165   -----+---------+---------+---------+---------+---------+----   3224

ACACAAGGCCGGCTCACCATTCGCATAGGTCAAACCAAATGTTGGTGAACGGCAACATCG
3225   -----+---------+---------+---------+---------+---------+----   3284

CCACAAGTCGCGTGCTAGTTCGAGGTTGTGTCCGGTGTACCGAGGCCACACTATTCGTGC
3285   -----+---------+---------+---------+---------+---------+----   3344

TGCCCGTCGCTGATATTTGCACGCGTAGCTGTCGACGAAAGTAGGTGGACTGACAGATAC
3345   -----+---------+---------+---------+---------+---------+----   3404

ACATATCCTCATTGCCTTCTCTGCTCGGTTTCTGCTAGGATTGCCATCTTCAGGAGTGCC
3405   -----+---------+---------+---------+---------+---------+----   3464

TATCCGCACGGCAGAAACGCGTAGCATCAGGCCAGAAAGCAGCGTGCGTGATATCGTAAC
3465   -----+---------+---------+---------+---------+---------+----   3524
```

FIGURE 39 CONTINUED

```
       CCAGACGGTCTTCACCTGTCCATTCTGGGCTACCTGGCATACTACCTCGGTGCCGCTGTG
3525   -----+---------+---------+---------+---------+---------+----   3584

CCGCTGACCAATTCGTGCACGACCACTATAGCAAAACCCTATGCATGTAACTGCTTCAAG
3585   -----+---------+---------+---------+---------+---------+----   3644

ATCAGCAGTGACATGTGCAATATAAACCTCAAGTGTGCACTCTAGTGCGTACTGATAAAA
3645   -----+---------+---------+---------+---------+---------+----   3704

CCGTATAACTGGTGACCCAGTCATTCTTCTCTTTTTTATTTGTTTGGACCAAACGAACAC
3705   -----+---------+---------+---------+---------+---------+----   3764

AGCATGTTATCCATCACCAACAAGTGGCGCTGATTTTTCAAACTACACTGGGATCATACT
3765   -----+---------+---------+---------+---------+---------+----   3824

GGAAACCAAAGCAGGAGAACATCTTCGAACCAAGAGATGTTTACTAAATTTGAAAGAAAA
3825   -----+---------+---------+---------+---------+---------+----   3884

TGTACTGACAAGTAATCTGTCTGAAGCAAGACACATACTACCTCGGTTCGAACGTGGGAC
3885   -----+---------+---------+---------+---------+---------+----   3944

ACCATGCCCGTGCCATATTTGCTAGGCACCACTCTGCCGTCGATTGTATCCCAACGGAGG
3945   -----+---------+---------+---------+---------+---------+----   4004

GAGTATCGATTTGCGCAAAGTTCCTACATACATAGCCGCTCAAGATATAATCTTACGACC
4005   -----+---------+---------+---------+---------+---------+----   4064

TTCCGTCGAAATCGGTGATACGTCGCAACCTATAGCTAACTTGGCAGAGCATAAAATAAC
4065   -----+---------+---------+---------+---------+---------+----   4124

TATCTAAGGTTGGGGTCTCCCTCTTTTCAATCAACCTTTCATACCGAATGATGGGAGTGT
4125   -----+---------+---------+---------+---------+---------+----   4184

TTGTGAAAACATCTCTTGGTCGACTCAGCATTAGCGCCCTACCAATTTCTCTGTGGACAA
4185   -----+---------+---------+---------+---------+---------+----   4244

TGCCACCTTAAATCGTTTTTTAGTCTTCATGATTTACTCCCCCTTATATCTGGCCGTAGT
4245   -----+---------+---------+---------+---------+---------+----   4304

CCCTCTTTTCCATTTTTCTTGTCTGGTTTTAAGTCAAATTTAGACTACTAAAACAACAGC
4305   -----+---------+---------+---------+---------+---------+----   4364

AAGATTTTATGGAAGGGAGGTAGTGCAAAACAGAAAGTCCGATCGAAATGCGTGCCAATT
4365   -----+---------+---------+---------+---------+---------+----   4424

TGTCGTCGCGGCGGCCGGACTAAAATGGATCTGCATGTGCATACCGTTCGTCGGAGTATC
4425   -----+---------+---------+---------+---------+---------+----   4484

CTGCGAACGGTCGTGTGTTTAGTCAACATTAATGTGAGGTTCATGTGATACTCTTGCTTG
4485   -----+---------+---------+---------+---------+---------+----   4544

AAAGATACTACTACTGCTACCTCGTAGAACTGAATGAAAGTATGTGGGACTGTTCAGCTC
4545   -----+---------+---------+---------+---------+---------+----   4604

TCTGCACATGTCAAATGTCGTTACTCATACCTTTCGTCAGAGCATCCTGCGACGCGCGCC
4605   -----+---------+---------+---------+---------+---------+----   4664

GGTGCCGAAATTTCGCCGTGTGTTTAGTCAAGATCAACGTGAGGTTCATGCGGTACCCTA
4665   -----+---------+---------+---------+---------+---------+----   4724
```

FIGURE 39 CONTINUED

```
        TCTGGCTTCGAAGATACCAAGCAGACTGCGGCTAGATTGTCATTTTGATGTCGCAATCTT
4725    -----+---------+---------+---------+---------+---------+----    4784

CACCAAACCTGCCCTTCCGGACCACAGCAGCAGTACGTAACAATGGTGTCATCGCCATGC
4785    -----+---------+---------+---------+---------+---------+----    4844

GTTGCTCGTGTCCAAGGAAACGGAGGAATCTCGGCTTCCCACAAGTCACGCATCGATGTT
4845    -----+---------+---------+---------+---------+---------+----    4904

CACACCTGAATTGGTCGACGTTTCTTCTTCTAGACTAGAAAAAGATTACAGAACAACGCA
4905    -----+---------+---------+---------+---------+---------+----    4964

AGCTTCGTTCAAGTCCATACTTCTGTTCAGTATACTCCTGATGATTGCAGTTATATCAGC
4965    -----+---------+---------+---------+---------+---------+----    5024

ATGTCTATTCTGAATTTTTGCACTTCTATTCAAAGGATGGGCTGGAATTGCTACTGACTT
5025    -----+---------+---------+---------+---------+---------+----    5084

TGGTGTGATGTGTGTGGCACAGGTGCTCTGATGAGACGAACCCGAGGAAGCAGCCATACA
5085    -----+---------+---------+---------+---------+---------+----    5144
                                     C  S  D  E  T  N  P  R  K  Q  P  Y  K

AGATGTCGAACCAGAAGCTCCAGGACCTCGGACTCGAGTTCAGGCCGGTGAGCCAGTCCC
5145    -----+---------+---------+---------+---------+---------+----    5204
           M  S  N  Q  K  L  Q  D  L  G  L  E  F  R  P  V  S  Q  S  L

TGTACGAGACGGTGAAGAGCCTCCAGGAGAAGGGCCACCTTCCGGTGCTCAGCGAGCAGG
5205    -----+---------+---------+---------+---------+---------+----    5264
           Y  E  T  V  K  S  L  Q  E  K  G  H  L  P  V  L  S  E  Q  A

CAGAGGCGGACAAGGAAACCCTAGCTGCCGAGCTGCAGGCAGGGGTTACCATCCGAGCAT
5265    -----+---------+---------+---------+---------+---------+----    5324
           E  A  D  K  E  T  L  A  A  E  L  Q  A  G  V  T  I  R  A  *

GAGGAACAAGAAATCAACCATGTCCATACTGCTACTGTCATGTAAACCAGCTGTTGAATG
5325    -----+---------+---------+---------+---------+---------+----    5384

CCTAAAATCTAAGTTCTTGTAATACTGTGTTGTTTCATGTGGACTAGATTGATCG
5385    -----+---------+---------+---------+---------+---------     5439
```

FIGURE 39 CONTINUED

LpCCR1 cDNA sequence
Deleted base
ATGACCATC GCC GAG

Modified forward primer sequence
CAAGTTTGTACAAAAAAGCAGGCTATGACCATC GC GAG
AttB1 site                                                                  Start site

MODIFICATION OF LIGNIN BIOSYNTHESIS VIA SENSE SUPPRESSION

The present invention relates to the modification of lignin biosynthesis in plants, to enzymes involved in the lignin biosynthetic pathway and nucleic acids encoding such enzymes and, more particularly, to methods of modifying lignin biosynthesis via sense suppression and to related nucleic acids and constructs.

The present invention also relates to a regulatory element and, more particularly, to a promoter capable of causing expression of an exogenous gene in plant cells, such as a gene encoding an enzyme involved in the lignin biosynthetic pathway in plants.

The invention also relates to vectors including the nucleic acids and regulatory elements of the invention, plant cells, plants, seeds and other plant parts transformed with the regulatory elements, nucleic acids and vectors, and methods of using the nucleic acids, regulatory elements and vectors.

Lignins are complex phenolic polymers that strengthen plant cell walls against mechanical and chemical degradation. The process of lignification typically occurs during secondary thickening of the walls of cells with structural, conductive or defensive roles. Three monolignol precursors, sinapyl, coniferyl and p-coumaryl alcohol combine by dehydrogenative polymerisation to produce respectively the syringyl(S), guaiacyl(G) and hydroxyl(H) subunits of the lignin polymer, which can also become linked to cell-wall polysaccharides through the action of peroxidases and other oxidative isozymes. In grasses, biosynthesis of the monolignol precursors is a multistep process beginning with the aromatic amino-acids phenylalanine and tyrosine. It is the final two reduction/dehydrogenation steps of the pathway, catalysed by Cinnamoyl CoA Reductase (CCR) and Cinnamyl Alcohol Dehydrogenase (CAD) that are considered to be specific to lignin biosynthesis. The proportions of monolignols incorporated into the lignin polymer vary depending on plant species, tissue, developmental stage and sub-cellular location.

Caffeic acid 0-methyl transferase (OMT), 4 coumarate CoA-ligase (4CL), cinnamoyl-CoA reductase (CCR) and cinnamyl alcohol dehydrogenase (CAD) are key enzymes involved in lignin biosynthesis.

Worldwide permanent pasture is estimated to cover 70% of agriculturally cultivated area. Ryegrasses (*Lolium* spp.) together with the closely related fescues (*Festuca* spp.) are of significant value in temperate grasslands. The commercially most important ryegrasses are Italian or annual ryegrass (*L multiforum* Lam.) and perennial ryegrass (*L perenne* L.). They are the key forage species in countries where livestock production is an intensive enterprise, such as the Netherlands, United Kingdom and New Zealand. The commercially most important fescues are tall fescue (*F. anundinacea* Schreb.), meadow fescue (*F. pratensis*) and red fescue (*F. rubra*).

Perennial ryegrass (*Lolium perenne* L.) is the major grass species sown in temperate dairy pastures in Australia, and the key pasture grass in temperate climates throughout the world. A marked decline of the feeding value of grasses is observed in temperate pastures of Australia during late spring and early summer, where the nutritive value of perennial ryegrass based pasture is often insufficient to meet the metabolic demands of lactating dairy cattle. Perennial ryegrass is also an important turf grass.

Grass and legume in vitro dry matter digestibility has been negatively correlated with lignin content. In addition, natural mutants of lignin biosynthetic enzymes in maize, sorghum and pearl millet that have higher rumen digestibility have been characterised as having lower lignin content and altered SIG subunit ratio. Thus, lignification of plant cell walls is the major factor identified as responsible for lowering digestibility of forage tissues as they mature.

It would be desirable to have methods of altering lignin biosynthesis in plants, including grass species such as ryegrasses and fescues, by reducing the activity of key biosynthetic enzymes in order to reduce lignin content and/or alter lignin composition for enhancing dry matter digestibility and improving herbage quality. However, for some applications it may be desirable to enhance lignin biosynthesis to increase lignin content and/or alter lignin composition, for example to increase mechanical strength of wood, to increase mechanical strength of turf grasses, to reduce plant height and reduce lodging or improve disease resistance.

While nucleic acid sequences encoding some of the enzymes involved in the lignin biosynthetic pathway have been isolated for certain species of plants, there remains a need for materials useful in the modification of lignin biosynthesis in plants, particularly grass species such as ryegrasses and fescues.

Other phenotypic traits which may be improved by transgenic manipulation of plants include disease resistance, mineral content, nutrient quality and drought tolerance.

However, transgenic manipulation of phenotypic traits in plants requires the availability of regulatory elements capable of causing the expression of exogenous genes in plant cells.

It is an object of the present invention to overcome, or at least alleviate, one or more of the difficulties or deficiencies associated with the prior art.

In one aspect, the present invention provides substantially purified or isolated nucleic acids or nucleic acid fragments encoding the following enzymes from a ryegrass (*Lolium*) or fescue (*Festuca*) species: 4 coumarate CoA-ligase (4CL), cinnamoyl-CoA reductase (CCR) and cinnamyl alcohol dehydrogenase (CAD).

The ryegrass (*Lolium*) or fescue (*Festuca*) species may be of any suitable type, including Italian or annual ryegrass, perennial ryegrass, tall fescue, meadow fescue and red fescue. Preferably the ryegrass or fescue species is a *Lolium* species such as *Lolium perenne* or *Lolium arundinaceum* which is otherwise known as *Festuca arundinacea*.

By 'nucleic acid' is meant a chain of nucleotides capable of carrying genetic information. The term generally refers to genes or functionally active fragments or variants thereof and or other sequences in the genome of the organism that influence its phenotype. The term 'nucleic acid' includes DNA (such as cDNA or genomic DNA) and RNA (such as mRNA or microRNA) that is single- or double-stranded, optionally containing synthetic, non-natural or altered nucleotide bases, synthetic nucleic acids and combinations thereof.

The nucleic acid or nucleic acid fragment may be of any suitable type and includes DNA (such as cDNA or genomic DNA) and RNA (such as mRNA) that is single- or double-stranded, optionally containing synthetic, non-natural or altered nucleotide bases, and combinations thereof.

By 'substantially purified' is meant that the nucleic acid or promoter is free of the genes, which, in the naturally-occurring genome of the organism from which the nucleic acid or promoter of the invention is derived, flank the nucleic acid or promoter. The term therefore includes, for example, a nucleic acid or promoter which is incorporated into a vector; into an autonomously replicating plasmid or virus; or into the genomic DNA of a prokaryote or eukaryote; or which exists as a separate molecule (e.g. a cDNA or a genomic or cDNA fragment produced by PCR or restriction endonuclease digestion) independent of other sequences. It also includes a nucleic acid or promoter which is part of a hybrid gene. Preferably, the substantially purified nucleic acid or promoter is at least approximately 90% pure, more preferably at least approximately 95% pure, even more preferably at least approximately 98% pure.

The term "isolated" means that the material is removed from its original environment (e.g. the natural environment if it is naturally occurring). For example, a naturally occurring nucleic acid present in a living plant is not isolated, but the same nucleic acid separated from some or all of the coexisting materials in the natural system, is isolated. Such nucleic acids could be part of a vector and/or such nucleic acids could be part of a composition, and still be isolated in that such a vector or composition is not part of its natural environment.

In a preferred embodiment of this aspect of the invention, the substantially purified or isolated nucleic acid or nucleic acid fragment encoding 4CL includes a nucleotide sequence selected from the group consisting of (a) sequences shown in FIGS. 2, 3 and 4 hereto (Sequence ID Nos: 1, 3 and 5; respectively) (b) complements of the sequences shown in FIGS. 2, 3 and 4 hereto (Sequence ID Nos: 1, 3 and 5, respectively); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding CCR includes a nucleotide sequence selected from the group consisting of (a) the sequence shown in FIG. 10 hereto (Sequence ID No: 7); (b) the complement of the sequence shown in FIG. 10 hereto (Sequence ID No: 7); (c) sequences antisense to the sequences recited in (a) and (b); and (d) functionally active fragments and variants of the sequences recited in (a), (b) and (c).

In a still further preferred embodiment of this aspect of the invention, the substantially purified or isolated nucleic acid or nucleic acid fragment encoding CAD includes a nucleotide sequence selected from the group consisting of (a) the sequences shown in FIGS. 13, 14, 26 and 27 hereto (Sequence ID Nos: 9, 11, 14 and 16, respectively); (c) sequences antisense to the sequences recited in (a) and (b); and (d) functionally active fragments and variants of the sequences recited in (a), (b) and (c).

By "functionally active" is meant that the fragment or variant (such as an analogue, derivative or mutant) is capable of participating in or modifying lignin biosynthesis in a plant. Such variants include naturally occurring allelic variants and non-naturally occurring variants. Additions, deletions, substitutions and derivatizations of one or more of the nucleotides are contemplated so long as the modifications do not result in loss of functional activity of the fragment or variant. Preferably the functionally active fragment or variant has at least approximately 80% identity to the relevant part of the above mentioned sequence to which the fragment or variant corresponds, more preferably at least approximately 90% identity, even more preferably at least approximately 95% identity, most preferably at least approximately 98% identity. Such functionally active variants and fragments include, for example, those having conservative nucleic acid changes. By 'conservative nucleic acid changes' is meant nucleic acid substitutions that result in conservation of the amino acid in the encoded protein, due to the degeneracy of the genetic code. Such functionally active variants and fragments also include, for example, those having nucleic acid changes which result in conservative amino acid substitutions of one or more residues in the corresponding amino acid sequence. By 'conservative amino acid substitutions' is meant the substitution of an amino acid by another one of the same class, the classes being as follows:

Nonpolar: Ala, Val, Leu, Ile, Pro, Met Phe, Trp Uncharged polar: Gly, Ser, Thr, Cys, Tyr, Asn, Gin
Acidic: Asp, Glu
Basic: Lys, Arg, His
Other conservative amino acid substitutions may also be made as follows:
Aromatic: Phe, Tyr, His
Proton Donor: Asn, Gin, Lys, Arg, His, Trp
Proton Acceptor: Glu, Asp, Thr, Ser, Tyr, Asn, Gin Preferably the fragment has a size of at least 20 nucleotides, more preferably at least 50 nucleotides, more preferably at least 100 nucleotides, more preferably at least 200 nucleotides, more preferably at least 500 nucleotides.

In a still further preferred embodiment of this aspect of the invention the functionally active fragment or variant may be capable of modifying lignin biosynthesis in a plant via sense suppression.

Accordingly, the present invention provides a substantially purified or isolated nucleic acid including a fragment or variant of a gene encoding a lignin biosynthetic enzyme, said nucleic acid being capable of modifying lignin biosynthesis in a plant via sense suppression.

By "sense suppression" is meant that when the functionally active fragment or variant is introduced into the plant in sense orientation, it causes an identifiable decrease in expression of the corresponding gene in the transformed plant relative to an untransformed control plant.

By "sense" orientation is meant that the nucleic acid is in the same orientation or has the same polarity as a messenger RNA copy that is translated or translatable into protein.

Fragments and variants for sense suppression include those with additions, deletions, substitutions or derivatizations of one or more nucleotides in the nucleic acid or nucleic acid fragment according to the present invention.

Fragments and variants for sense suppression preferably include those with short deletions of, for example 1 to approximately 500, 1 to approximately 300 or 1 to approximately 100 nucleotides, preferably consecutive nucleotides. In a preferred embodiment, the short deletion may be located at or near, for example within approximately 200, 100, 50 or 20 bases of, the 3' or 5' end of the gene upon which the fragment or variant is based.

In a preferred embodiment of this aspect of the invention, the functionally active fragment or variant capable of modifying lignin biosynthesis via sense suppression may be a functionally active fragment or variant of a nucleic acid or nucleic acid fragment encoding 4CL, CCR or CAD, for example as herein before described, or as described in International patent applications WO 02/26994 or WO 03/40306; or a functionally active fragment or variant of a nucleic acid or nucleic acid fragment encoding cinnamate-4-hydroxase (C4H), caffeoyl-CoA3-0-methyltransferase (CCoAOMT or CCoAMT), caffeic acid 0-methyltransferase (OMT or COMT), ferulate-5-hydroxylase (F5H) or phenylalanine ammonia lyase (PAL), for example as described in International patent application WO 02/26994 or WO 03/40306; or a functionally active fragment or variant of cinnamate-3-hydroxylase (C3H), for example as described in International patent application WO 2008/064289.

Preferably the functionally active fragment or variant encodes a 4CL, CCR CAD, C3H, C4H, CCoAOMT, COMT, F5H or PAL polypeptide without enzymatic activity or with substantially reduced enzymatic activity.

By "substantially reduced enzymatic activity" is meant enzymatic activity which is significantly lower, for example at least approximately 25%, 50% or 75% lower, than the enzymatic activity in a wild type plant.

Preferably the functionally active fragment or variant includes a frame-shift mutation relative to the corresponding gene upon which the fragment or variant is based. This may result in a loss of or substantial reduction in enzymatic activity in the encoded polypeptide.

By a "frame-shift mutation" is meant a mutation that inserts or deletes a number of nucleotides that is not evenly divisible by three from a nucleic acid sequence. Due to the triplet nature of gene expression by codons, the insertion or deletion may disrupt the reading frame, or the grouping of the nucleotides into codons, resulting in a different translation from the original. The earlier in the sequence the deletion or insertion occurs, the greater is the proportion of the protein that is altered.

A frame-shift mutation may cause the reading of codons to be different, so most codons after the mutation (with a few exceptions due to redundancy or coincidental similarity) will code for different amino acids than the corresponding codon in the wild type sequence, leading to a substantially altered polypeptide sequence. Furthermore, the stop codon "UAA, UGA, or UAG" may not be read, or a stop codon may be created at an earlier site. The protein being created may be abnormally short, abnormally long, and/or contain the wrong amino acids. It is unlikely to be functional.

Deletions or additions occurring at or near the 5' end may preferably be within a short distance, for example within approximately 20, 50, 100 or 200 bases of the ATG start codon, preferably within a short distance downstream of the ATG start codon, for example within approximately 20, 50, 100 or 200 bases downstream of the ATG start codon.

By "downstream" is meant in the 5' 3' direction along the nucleic acid. Preferably, such deletions or additions occurring at or near the 5' end may result in a frame-shift mutation, so that the resulting polypeptide has little or no enzymatic activity.

In a particularly preferred embodiment, the deletion or addition at or near the 5' end may be a deletion or addition of one, two, four, five, seven or eight bases, preferably consecutive bases, within a short distance downstream of the ATG start codon, so as to result in a frame-shift mutation, and a resulting polypeptide with little or no enzymatic activity. More preferably the frame-shift mutation is a deletion of one base.

Deletions occurring at or near the 3' end may preferably start at the 3' end or within a short distance, for example approximately 20, 50, 100 or 200 bases, of the 3' end, and extend in a 5' direction. Preferably, such deletions have a size of between approximately 50 to 500 nucleotides, more preferably approximately 100 to 300 nucleotides.

In a particularly preferred embodiment of this aspect of the invention, the functionally active fragment or variant capable of modifying lignin biosynthesis via sense suppression may be a functionally active fragment or variant of a nucleic acid or nucleic acid fragment encoding CCR, 4CL or CAD, C3H, C4H, CCoAOMT, COMT, F5H or PAL.

Accordingly, in a preferred embodiment the present invention provides a fragment or variant of a nucleic acid selected from the group consisting of nucleic acids with the sequences shown in FIG. 10 hereto (Sequence ID No: 7), and in FIGS. 38, 40, 41, 43 and 44 of WO 02/26994 (Sequence ID Nos: 244 to 251, respectively) and in SEQ ID Nos: 147 and 148 of WO 03/40306 (Seq ID Nos. 117 and 121 of this application); wherein said fragment or variant is capable of modifying lignin biosynthesis in a plant via sense suppression of a gene encoding CCR in said plant.

In a further preferred embodiment the present invention provides a fragment or variant of a nucleic acid selected from the group consisting of the nucleic acids with sequences shown in FIGS. 13, 14, 26 and 27 hereto (Sequence ID Nos: 9, 11, 14 and 16, respectively), and in FIGS. 9, 11, 13, 15, 16, 18, 19, 21 and 22 of WO 02/26994 (Sequence ID Nos: 252 to 269, respectively) and in SEQ ID No: 7 of WO 2008/064289 (Seq ID No. 361 of this application) and in SEQ ID Nos: 35 and 145 of WO 03/40306 (Seq ID Nos 53 and 57 of this application; wherein said fragment or variant is capable of modifying lignin biosynthesis in a plant via sense suppression of a gene encoding CAD in said plant.

In a further preferred embodiment, the present invention provides a fragment or variant of a nucleic acid selected from the group consisting of the nucleic acids with sequences shown in FIGS. 2, 3 and 4 hereto (Sequence ID Nos: 1, 3 and 5, respectively) and in FIGS. 68, 70, 71 and 73 of WO 02/26994 (Sequence ID Nos: 235-243, respectively) and in SEQ ID Nos: 29, 31, 27, 142 and 143 of WO 03/40306 (Seq ID Nos 21, 25, 33 and 37 of this application); wherein said fragment or variant is capable of modifying lignin biosynthesis in a plant via sense suppression of a gene encoding 4CL in said plant.

In a further preferred embodiment, the present invention provides a fragment or variant of a nucleic acid selected from the group consisting of the nucleic acids with sequences shown in FIGS. 32, 34, 36 and 76 of WO 02/26994 (Sequence ID Nos: 270-273, respectively) and in SEQ ID No: 6 of WO 2008/064289 (Seq ID No. 49 of this application) and in SEQ ID Nos: 33 and 144 of WO 03/40306 (Seq ID Nos. 41 and 45 of this application); wherein said fragment or variant is capable of modifying lignin biosynthesis in a plant via sense suppression of a gene encoding C4H in said plant.

In a further preferred embodiment, the present invention provides a fragment or variant of a nucleic acid selected from the group consisting of the nucleic acids with sequences shown in FIGS. 1, 3, 4, 6, 7, 82 and 87 of WO 02/26994 (Sequence ID Nos: 274 to 294, respectively) and in SEQ ID No: 8 of WO 2008/064289 (Seq ID No. 362 of this application) and in SEQ ID Nos: 37 and 146 of WO 03/40306 (Seq ID Nos. 89 and 93 of this application); wherein said fragment or variant is capable of modifying lignin biosynthesis in a plant via sense suppression of a gene encoding CCoAOMT in said plant.

In a further preferred embodiment, the present invention provides a fragment or variant of a nucleic acid selected from the group consisting of the nucleic acids with sequences shown in FIGS. 24, 26, 27, 29, 30, 93 and 99 of WO 02/26994 (Sequence ID Nos: 295 to 342, respectively) and SEQ ID Nos: 2, 8 and 9 of WO 2008/064289 (Seq ID Nos. 360, 362 and 363 of this application) and in SEQ ID Nos: 149, 42, 150 and 43 of WO 03/40306 (Seq ID Nos. 133, 137, 141 and 145 of this application); wherein said fragment or variant is capable of modifying lignin biosynthesis in a plant via sense suppression of a gene encoding COMT in said plant.

In a further preferred embodiment, the present invention provides a fragment or variant of a nucleic acid selected from the group consisting of the nucleic acids with sequences shown in FIGS. 59 and 61 of WO 02/26994 (Sequence ID Nos: 343 to 346, respectively) and in SEQ ID Nos: 45 and 151 of WO 03/40306 (Seq ID Nos. 173 and 177 of this application); wherein said fragment or variant is capable of modifying lignin biosynthesis in a plant via sense suppression of a gene encoding F5H in said plant.

In a further preferred embodiment, the present invention provides a fragment or variant of a nucleic acid selected from the group consisting of the nucleic acids with sequences shown in FIGS. 62, 64, 65 and 67 of WO 02/26994 (Sequence ID Nos: 347 to 358; respectively) and in SEQ ID Nos: 152, 153, 50, 54, 48, 53, 156, 49, 51, 154, 52 and 155 of WO 03/40306 (Seq ID Nos. 181, 185, 189, 193,197,201,205,209,213, 217, 220 and 224 of this application); wherein said fragment or variant is capable of modifying lignin biosynthesis in a plant via sense suppression of a gene encoding PAL in said plant.

In a further preferred embodiment, the present invention provides a fragment or variant of a nucleic acid selected from the group consisting of the nucleic acids with sequences shown in SEQ ID No: 1 of WO 2008/064289 (Seq ID No. 359 of this application) wherein said fragment or variant is capable of modifying lignin biosynthesis in a plant via sense suppression of a gene encoding C3H in said plant.

Preferably, the fragment or variant includes a short deletion at or near the 3' or 5' end of a sequence as hereinbefore described.

Preferably, the fragment or variant includes a frame-shift mutation relative to a sequence, as hereinbefore described. In a particularly preferred embodiment, the fragment or variant comprises sequence selected from the group of frame shift DNA sequences shown in Tables 1 and 2 or encodes a polypeptide comprising a sequence selected from the group of frame shift protein sequences shown in Tables 1 and 2.

TABLE 1

| SEQ ID NO. DNA | SEQ ID NO. PROT | Species | Gene name | Abbrev | DNA Seq ID NO. | No of NT | PORT SEQ ID NO. |
|---|---|---|---|---|---|---|---|
| 4CL | | | | | | | |
| 29 | 91 | Fescue | 4 Coumarate CoA ligase 2 | 4CL-2 | 21 | 1934 | 22 |
| 31 | 93 | Fescue | 4 Coumarate CoA ligase3 | 4CL-3 | 25 | 2073 | 26 |
| 27 | 89 | Lolium | 4 Coumarate CoA ligase 1 | 4CL-1 | 29 | 1855 | 30 |
| 142 | 90 | Lolium | 4 Coumarate CoA ligase 2 | 4CL-2 | 33 | 2039 | 34 |
| 143 | 178 | Lolium | 4 Coumarate CoA ligase 3 | 4CL-3 | 37 | 2006 | 38 |
| C4H | | | | | | | |
| 33 | 95 | Fescue | cinnamate-4-hydroxylase | C4H | 41 | 1775 | 42 |
| 144 | 179 | Lolium | cinnamate 4-hydroxylase | C4H | 45 | 1789 | 46 |
| | | Fescue | cinnamate 4-hydroxylase | LaC4H | 49 | 1518 | 50 |
| CAD3 | | | | | | | |
| 35 | 97 | Fescue | cinnamyl alcohol dehydrogenase | CAD | 53 | 1313 | 54 |
| 145 | 180 | Lolium | cinnamyl alcohol dehydrogenase | CAD | 57 | 1358 | 58 |
| CAD | | | | | | | |
| | | Fescue | cinnamyl alcohol dehydroqenase | LaCAD1a | 61 | 1501 | 62 |
| | | Fescue | cinnamyl alcohol dehydrogenase | LaCAD1b | 65 | 1339 | 66 |
| | | Fescue | cinnamyl alcohol dehydrogenase | LaCAD2a | 69 | 1322 | 70 |
| | | Fescue | cinnamyl alcohol dehydrogenase | LaCAD2b | 73 | 1526 | 74 |
| | | Lolium | cinnamyl alcohol dehydrogenase | LpCAD1 | 77 | 1325 | 78 |
| | | Lolium | cinnamyl alcohol dehydrogenase | LpCAD2 | 81 | 1378 | 82 |
| | | Lolium | cinnamyl alcohol dehydrogenase | LpCAD3 | 85 | 1382 | 86 |
| CCoAOMT | | | | | | | |
| 37 | 99 | Fescue | Caffeoyl CoA O-methyltransferase | CCoAOMT | 89 | 1063 | 90 |
| 146 | 98 | Lolium | Caffeoyl CoA O-methyltransferase | CCoAOMT | 93 | 1051 | 94 |
| | | Lolium | Caffeoyl CoA O-methyltransferase | LpCCoAOMT1 | 97 | 1126 | 98 |
| | | Lolium | Caffeoyl CoA O-methyltransferase | LpCCoAOMT2 | 101 | 1164 | 102 |
| | | Lolium | Caffeoyl CoA O-methyltransferase | LpCCoAOMT3 | 105 | 1088 | 106 |
| | | Lolium | Caffeoyl CoA O-methyltransferase | lpCCoAOMT4 | 109 | 1241 | 110 |
| | | Lolium | Caffeoyl CoA O-methyltransferase | LpCCoAOMT5 | 113 | 1151 | 114 |

TABLE 1-continued

| | | | | | | | | |
|---|---|---|---|---|---|---|---|---|
| CCR | | | | | | | | |
| 148 | 101 | Fescue | cinnamoyl CoA reductase | CCR | | 117 | 1236 | 118 |
| 147 | 181 | Lolium | cinnamoyl CoA reductase | CCR | | 121 | 1332 | 122 |
| | | Lolium | cinnamoyl CoA reductase | LpCCR1 | | 125 | 1395 | 126 |
| | | Lolium | cinnamoyl CoA reductase | LpCCR2 | | 129 | 1207 | 130 |
| COMT | | | | | | | | |
| 149 | 182 | Fescue | caffeic acid O-methyltransferase | COMT | | 133 | 1428 | 134 |
| 42 | 104 | Fescue | caffeic acid O-methyltransferase 1 | COMT-1 | | 137 | 1452 | 138 |
| 150 | 103 | Lolium | caffeic acid O-methyltransferase 1 | COMT-1 | | 141 | 1455 | 142 |
| 43 | 105 | Lolium | caffeic acid O-methyltransferase 3 | COMT-3 | | 145 | 1440 | 146 |
| | | Fescue | caffeic acid O-methyltransferase 1 | LaCOMT1c | | 149 | 1438 | 150 |
| | | Fescue | caffeic acid O-methyltransferase 1 | LaCOMT3 | | 153 | 1430 | 154 |
| | | Lolium | caffeic acid O-methyltransferase 3 | LpOMT1 | | 157 | 1542 | 158 |
| | | Lolium | caffeic acid O-methyltransferase 3 | LpOMT2 | | 161 | 1496 | 162 |
| | | Lolium | caffeic acid O-methyltransferase 3 | LpOMT3 | | 165 | 1505 | 166 |
| | | Lolium | caffeic acid O-methyltransferase 3 | LpOMT4 | | 169 | 1366 | 170 |
| F5H | | | | | | | | |
| 45 | 107 | Fescue | Ferulate 5-hydroxylase | F5H | | 173 | 2051 | 174 |
| 151 | 183 | Lolium | Ferulate 5-hydroxylase | F5H | | 177 | 2101 | 178 |
| PAL | | | | | | | | |
| 152 | 108 | Lolium | Phenylalanine ammonia lyase | PAL | | 181 | 2460 | 182 |
| 153 | 184 | Fescue | Phenylalanine ammonia lyase | PAL | | 185 | 2595 | 186 |
| 50 | 112 | Fescue | Peroxidase | PER | | 189 | 1205 | 190 |
| 54 | 116 | Fescue | Peroxidase | PER | | 193 | 1266 | 194 |
| 48 | 110 | Fescue | Peroxidase | PER | | 197 | 1301 | 198 |
| 53 | 1115 | Lolium | Peroxidase | PER | | 201 | 1059 | 202 |
| 156 | 185 | | Peroxidase | PER | | 205 | 1204 | 206 |
| 49 | 111 | Lolium | Peroxidase | PER | | 209 | 1236 | 210 |
| 51 | 113 | Lolium | Peroxidase | PER | | 213 | 1382 | 214 |
| 154 | | | Peroxidase | PER | | 217 | 1382 | |
| 52 | 114 | Lolium | Peroxidase | PER | | 220 | 1261 | 221 |
| 155 | | | Peroxidase | PER | | 224 | 1260 | |

| SEQ ID NO. DNA | No of AA | ORF start | ORF end | Frame shift DNA SEQ ID NO. | Frame shift protein SEQ ID NO. | Important Info |
|---|---|---|---|---|---|---|
| 4CL | | | | | | |
| 29 | 559 | 72 | 1751 | 23 | 24 | From WO 03/40306 |
| 31 | 557 | 137 | 1810 | 27 | 28 | From WO 03/40306 |
| 27 | 539 | 3 | 1622 | 31 | 32 | From WO 03/40306 |
| 142 | 559 | 85 | 1764 | 35 | 36 | From WO 03/40306 Corrected SEQ 28, no chang in protein seq |
| 143 | 557 | 126 | 1799 | 39 | 40 | From WO 03/40306 Corrected SEQ 30 and 92 |
| C4H | | | | | | |
| 33 | 505 | 80 | 1597 | 43 | 44 | From WO 03/40306 |
| 144 | 501 | 61 | 1566 | 47 | 47 | From WO 03/40306 Corrected SEQ 32 and 94 |
| | 506 | 1 | 1518 | 51 | 52 | From US patent WO 2008/064289 also known as PCT/US2007/085344 |
| CAD3 | | | | | | |
| 35 | 361 | 86 | 1171 | 55 | 56 | From WO 03/40306 |
| 145 | 361 | 67 | 1152 | 59 | 60 | From WO 03/40306 FL of SEQ 34 and 96 |

TABLE 1-continued

| | | | | | | |
|---|---|---|---|---|---|---|
| CAD | | | | | | |
| | 361 | 40 | 1125 | 63 | 64 | AF188292 |
| | 361 | 40 | 1125 | 67 | 68 | AF188293; Also in US patent WO 2008/064289 also known as PCT/US2007/085344 |
| | 361 | 91 | 1176 | 71 | 72 | AF188294 |
| | 361 | 91 | 1176 | 75 | 76 | AF188295 |
| | 407 | 22 | 1245 | 79 | 80 | |
| | 370 | 102 | 1214 | 83 | 84 | |
| | 361 | 81 | 1166 | 87 | 88 | |
| CCoAOMT | | | | | | |
| 37 | 265 | 75 | 872 | 91 | 92 | From WO 03/40306 |
| 146 | 265 | 55 | 852 | 95 | 96 | From WO 03/40306 Corrected SEQ 36, no change in protein seq |
| | 261 | 132 | 917 | 99 | 100 | |
| | 261 | 135 | 920 | 103 | 104 | |
| | 243 | 171 | 902 | 107 | 108 | |
| | 243 | 170 | 901 | 111 | 112 | |
| | 265 | 137 | 934 | 115 | 116 | |
| CCR | | | | | | |
| 148 | 342 | 90 | 1118 | 119 | 120 | From WO 03/40306 Corrected SEQ 39, no change in protein seq |
| 147 | 363 | 148 | 1239 | 123 | 124 | From WO 03/40306 Corrected SEQ 38 and 100 |
| | 362 | 150 | 1238 | 127 | 128 | |
| | 344 | 1 | 1035 | 131 | 132 | From NCBI Accession # AF278698 |
| COMT | | | | | | |
| 149 | 360 | 27 | 1109 | 135 | 136 | From WO 03/40306 Corrected SEQ 40 and 102. Also in US patent WO 2008/064289 also known as PCT/US2007/085344 |
| 42 | 360 | 64 | 1146 | 139 | 140 | From WO 03/40306 |
| 150 | 360 | 66 | 1148 | 143 | 144 | From WO 03/40306 Corrected SEQ 41, no change in protein seq |
| 43 | 361 | 85 | 1170 | 147 | 148 | From WO 03/40306 |
| | 360 | 62 | 1144 | 151 | 152 | NCBI accession no AF153825 |
| | 360 | 78 | 1160 | 155 | 156 | NCBI accession no AF153826 |
| | 360 | 139 | 1221 | 159 | 160 | |
| | 351 | 135 | 1187 | 163 | 164 | |
| | 361 | 156 | 1238 | 167 | 168 | |
| | 367 | 107 | 1209 | 171 | 172 | |
| F5H | | | | | | |
| 45 | 542 | 93 | 1721 | 175 | 176 | From WO 03/40306 |
| 151 | 543 | 87 | 1718 | 179 | 180 | From WO 03/40306 Corrected SEQ 44 and 106 |
| PAL | | | | | | |
| 152 | 711 | 111 | 2246 | 183 | 184 | From WO 03/40306 Corrected SEQ 46, no change in protein seq |
| 153 | 713 | 143 | 2284 | 187 | 188 | From WO 03/40306 Corrected SEQ 47 and 109 |
| 50 | 326 | 87 | 1067 | 191 | 192 | From WO 03/40306 |
| 54 | 311 | 80 | 1015 | 195 | 196 | From WO 03/40306 |
| 48 | 323 | 22 | 993 | 199 | 200 | From WO 03/40306 |
| 53 | 293 | 1 | 882 | 203 | 204 | From WO 03/40306 |
| 156 | 324 | 46 | 1017 | 207 | 208 | From WO 03/40306 FL of SEQ 53 and 115, now two sequences with difference in 5' region with SEQ ID NO 162 |
| 49 | 344 | 4 | 1038 | 211 | 212 | From WO 03/40306 |
| 51 | 358 | 59 | 1135 | 215 | 216 | From WO 03/40306 |
| 154 | | | | 218 | 219 | From WO 03/40306 Corrected SEQ 51, no change in protein seq |
| 52 | 344 | 18 | 1052 | 222 | 223 | From WO 03/40306 |

TABLE 1-continued

| | | | | 155 | | 225 | 226 | | | | | From WO 03/40306 Corrected SEQ 52, no change in protein seq |
|---|---|---|---|---|---|---|---|---|---|---|---|---|

TABLE 2

| Grass | Species | Gene name | Abbrev | DNA SEQ ID NO. | No of NT | PROT SEQ ID NO. | No of AA | ORF start | ORF end | Frame shift DNA SEQ ID NO. | Frame shift protein SEQ ID NO. | Important Info |
|---|---|---|---|---|---|---|---|---|---|---|---|---|
| Bermuda grass | Cynodon dactylon | cinnamate 3-hydroxylase | C3H | 227 | 1539 | 228 | 512 | 1 | 1539 | 229 | 230 | From US patent WO 2008/064289 also known as PCT/US2007/085344 |
| | Cynodon dactylon | caffeic acid O-methyltransferase | COMT | 231 | 789 | 232 | 262 | 1 | 789 | 233 | 234 | From US patent WO 2008/064289 also known as PCT/US2007/085344 |

In a second aspect of the present invention there is provided a genetic construct or a vector including a nucleic acid or nucleic acid fragment according to the present invention.

In a preferred embodiment of this aspect of the invention, the vector may include a regulatory element such as a promoter, a nucleic acid or nucleic acid fragment, according to the present invention and a terminator; said regulatory element, nucleic acid or nucleic acid fragment and terminator being operatively linked.

By 'genetic construct' is meant a recombinant nucleic acid molecule.

By a 'vector' is meant a genetic construct used to transfer genetic material to a target cell.

By 'operatively linked' is meant that the nucleic acid(s) and a regulatory sequence, such as a promoter, are linked in such a way as to permit expression of said nucleic acid under appropriate conditions, for example when appropriate molecules such as transcriptional activator proteins are bound to the regulatory sequence. Preferably an operatively linked promoter is upstream of the associated nucleic acid.

The vector may be of any suitable type and may be viral or non-viral. The vector may be an expression vector. Such vectors include chromosomal, non-chromosomal and synthetic nucleic acid sequences, e.g. derivatives of plant viruses; bacterial plasmids; derivatives of the Ti plasmid from *Agrobacterium tumefaciens*; derivatives of the Ri plasmid from *Agrobacterium rhizogenes*; phage DNA; yeast artificial chromosomes; bacterial artificial chromosomes; binary bacterial artificial chromosomes; vectors derived from combinations of plasmids and phage DNA. However, any other vector may be used as long as it is replicable or integrative or viable in the plant cell.

The regulatory element and terminator may be of any suitable type and may be endogenous to the target plant cell or may be exogenous, provided that they are functional in the target plant cell.

Preferably the regulatory element is a promoter. A variety of promoters which may be employed in the vectors of the present invention are well known to those skilled in the art. Factors influencing the choice of promoter include the desired tissue specificity of the vector, and whether constitutive or inducible expression is desired and the nature of the plant cell to be transformed (e.g. monocotyledon or dicotyledon). Particularly suitable promoters include the Cauliflower Mosaic Virus 35S (CaMV 35S) promoter, the maize Ubiquitin promoter, the rice Actin promoter, and ryegrass endogenous OMT, 4CL, CCR or CAD promoters.

A variety of terminators which may be employed in the vectors of the present invention are also well known to those skilled in the art. The terminator may be from the same gene as the promoter sequence or a different gene. Particularly suitable terminators are polyadenylation signals, such as the CaMV 35S polyA and other terminators from the nopaline synthase (nos) and the octopine synthase (ocs) genes.

The vector, in addition to the regulatory element, the nucleic acid or nucleic acid fragment of the present invention and the terminator, may include further elements necessary for expression of the nucleic acid or nucleic acid fragment, in different combinations, for example vector backbone, origin of replication (ori), multiple cloning sites, spacer sequences, enhancers, introns (such as the maize Ubiquitin Ubi intron), antibiotic resistance genes and other selectable marker genes [such as the neomycin phosphotransferase (npt2) gene, the hygromycin phosphotransferase (hph) gene, the phosphinothricin acetyltransferase (bar or pat) gene], and reporter genes (such as beta-glucuronidase (GUS) gene (gusA)]. The vector may also contain a ribosome binding site for translation initiation. The vector may also include appropriate sequences for amplifying expression.

As an alternative to use of a selectable marker gene to provide a phenotypic trait for selection of transformed host cells, the presence of the vector in transformed cells may be determined by other techniques well known in the art, such as PCR (polymerase chain reaction), Southern blot hybridisation analysis, histochemical GUS assays, northern and Western blot hybridisation analyses.

Those skilled in the art will appreciate that the various components of the vector are operatively linked, so as to result in expression of said nucleic acid or nucleic acid fragment. Techniques for operatively linking the components of the vector of the present invention are well known to those skilled in the art. Such techniques include the use of linkers, such as synthetic linkers, for example including one or more restriction enzyme sites.

The vectors of the present invention may be incorporated into a variety of plants, including monocotyledons (such as grasses from the genera *Lolium*, *Festuca*, *Cynodon*, *Brachiaria*, *Paspalum*, *Panicum*, *Miscanthus*, *Pennisetum*, *Phalaris*, and other forage, turf and bioenergy grasses, corn, oat, sugarcane, wheat and barley), dicotyledons (such as *Arabidopsis*, tobacco, legumes, Alfalfa, oak, *Eucalyptus*, maple, *Populus*, canola, soybean and chickpea) and gymnosperms (such as *Pinus*). In a preferred embodiment, the vectors are used to transform monocotyledons, preferably grass species such as *Lolium, Festuca, Cynodon, Bracharia, Paspalum, Panicum, Miscanthus, Pennisetum, Phalaris*, and other forage, turf and bioenergy grasses, more preferably a *Lolium* species such as *Lolium perenne* or *Lolium arundinaceum*, including cultivars for forage and turf applications.

Techniques for incorporating the vectors of the present invention into plant cells (for example by transduction, transfection or transformation) are well known to those skilled in the art. Such techniques include *Agrobacterium* mediated introduction, electroporation to tissues, cells and protoplasts, protoplast fusion, injection into reproductive organs, injection into immature embryos and high velocity projectile introduction to cells, tissues, calli, immature and mature embryos. The choice of technique will depend largely on the type of plant to be transformed.

Cells incorporating the vector of the present invention may be selected, as described above, and then cultured in an appropriate medium to regenerate transformed plants, using techniques well known in the art. The culture conditions, such as temperature, pH and the like, will be apparent to the person skilled in the art. The resulting plants may be reproduced, either sexually or asexually, using methods well known in the art, to produce successive generations of transformed plants.

In a further aspect of the present invention there is provided a transformed plant cell, plant, plant seed or other plant part, or plant biomass, including digestible biomass such as hay, including, e.g. transformed with, a nucleic acid, genetic construct or vector of the present invention. Preferably the transgenic plant cell, plant, plant seed or other plant part is produced by a method according to the present invention.

The present invention also provides a transgenic plant, plant seed or other plant part, or plant biomass, derived from a plant cell of the present invention and including a nucleic acid, genetic construct or vector of the present invention.

The present invention also provides a transgenic plant, plant seed or other plant, part or plant biomass, derived from a plant of the present invention and including a nucleic acid, genetic construct or vector of the present invention.

The nucleic acid, genetic construct or vector of the present invention may be stably integrated into the genome of the plant, plant seed, other plant part or plant biomass.

The plant cell, plant, plant seed or other plant part may be from any suitable species, including monocotyledons, dicotyledons and gymnosperms. In a preferred embodiment the plant cell, plant, plant seed or other plant part may be from a monocotyledon, preferably a grass species, such as *Lolium, Festuca, Cynodon, Bracharia, Paspalum, Panicum, Miscanthus, Pennisetum, Phalaris*, and other forage, turf and bioenergy grasses, more preferably a *Lolium* species such as *Lolium perenne* or *Lolium arundinaceum*.

In a further aspect of the present invention there is provided a method of modifying lignin biosynthesis in a plant, said method including introducing into said plant an effective amount of a nucleic acid or nucleic acid fragment, genetic construct and/or a vector according to the present invention.

By "an effective amount" is meant an amount sufficient to result in an identifiable phenotypic trait in said plant, or a plant, plant seed or other plant part, or plant biomass derived therefrom. Such amounts can be readily determined by an appropriately skilled person, taking into account the type of plant, the route of administration and other relevant factors. Such a person will readily be able to determine a suitable amount and method of administration. See, for example, Maniatis et al, Molecular Cloning: A Laboratory Manual, Cold Spring Harbor Laboratory, Cold Spring Harbor, the entire disclosure of which is incorporated herein by reference.

Using the methods and materials of the present invention, plant lignin biosynthesis may be increased, decreased or otherwise modified relative to an untransformed control plant. It may be increased or otherwise modified, for example, by incorporating additional copies of a sense nucleic acid or nucleic acid fragment of the present invention. It may be decreased, for example, by incorporating an antisense nucleic acid or nucleic acid fragment of the present invention or by incorporating a functionally active fragment or variant which is capable of modifying lignin biosynthesis in a plant via sense suppression. In addition, the number of copies of genes encoding for different enzymes in the lignin biosynthetic pathway may be manipulated to modify the relative amount of each monolignol synthesized, thereby leading to the formation of lignin having altered composition.

Accordingly, in a preferred embodiment of this aspect of the invention there is provided a method of modifying lignin biosynthesis in a plant, said method including introducing into said plant in sense orientation an effective amount of a nucleic acid, genetic construct or vector according to the present invention, such that expression of the corresponding gene is suppressed.

Preferred functionally active fragments and variants for sense suppression include those hereinbefore described.

In a further aspect of the present invention there is provided use of a nucleic acid, genetic construct or vector according to the present invention for sense suppression of lignin biosynthesis in a plant.

In a still further aspect of the present invention there is provided use of a nucleic acid or nucleic acid fragment according to the present invention, and/or nucleotide sequence information thereof, and/or single nucleotide polymorphisms thereof, as a molecular genetic marker.

More particularly, nucleic acids or nucleic acid fragments according to the present invention, and/or nucleotide sequence information thereof, and/or single nucleotide polymorphisms thereof, may be used as a molecular genetic marker for qualitative trait loci (QTL) tagging, mapping, DNA fingerprinting and in marker assisted selection, and may be used as candidate genes or perfect markers, particularly in ryegrasses and fescues. Even more particularly, nucleic acids or nucleic acid fragments according to the present invention, and/or nucleotide sequence information thereof, may be used as molecular genetic markers in forage and turf grass improvement, e.g. tagging QTLs for dry matter digestibility, herbage quality, mechanical stress tolerance, disease resistance, insect pest resistance, plant stature and leaf and stem colour.

In a still further aspect of the present invention there is provided a substantially purified or isolated polypeptide from a ryegrass (*Lolium*) or fescue (*Fustuca*) species, selected from the group consisting of the enzymes 4CL, CCR and CAD.

The ryegrass (*Lolium*) or fescue (*Festuca*) species may be of any suitable type, including Italian or annual ryegrass, perennial ryegrass, tall fescue, meadow fescue and red fescue. Preferably the species is a ryegrass, more preferably perennial ryegrass *L. perenne*).

In a preferred embodiment of this aspect of the invention, the substantially purified or isolated enzyme 4CL includes an amino acid sequence selected from the group consisting of sequences shown in FIGS. 2, 3 and 4 hereto (Sequence ID Nos: 2, 4 and 6, respectively); and functionally active fragments and variants thereof.

In a further preferred embodiment of this aspect of the invention, the substantially purified or isolated enzyme CCR includes an amino acid sequence selected from the group consisting of the sequence shown in FIG. 10 hereto (Sequence ID No: 8); and functionally active fragments and variants thereof.

In a still further preferred embodiment of this aspect of the invention, the substantially purified or isolated enzyme CAD includes an amino acid sequence selected from the group consisting of the sequence shown in FIGS. 13, 14, 26 and 27 hereto (Sequence ID Nos: 10, 12, 15 and 17, respectively); and functionally active fragments and variants thereof.

By "functionally active" in this context is meant that the fragment or variant has one or more of the biological properties of the enzymes 4CL, CCR and CAD, respectively. Additions, deletions, substitutions and derivatizations of one or more of the amino acids are contemplated so long as the modifications do not result in loss of functional activity of the fragment or variant. Preferably the fragment or variant has at least approximately 60% identity to the relevant part of the above mentioned sequence, more preferably at least approximately 80% identity, most preferably at least approximately 90% identity. Such functionally active variants and fragments include, for example, those having conservative amino acid substitutions of one or more residues in the corresponding amino acid sequence. Preferably the fragment has a size of at least 10 amino acids, more preferably at least 15 amino acids, most preferably—at least 20 amino acids.

In a further embodiment of this aspect of the invention, there is provided a polypeptide recombinantly produced from a nucleic acid or nucleic acid fragment according to the present invention. Techniques for recombinantly producing polypeptides are well known to those skilled in the art.

In a still further aspect of the present invention there is provided a lignin or modified lignin substantially or partially purified or isolated from a plant, plant seed or other plant part of the present invention.

Such lignins may be modified from naturally occurring lignins in terms of the length, the degree of polymerisation (number of units), degree of branching and/or nature of linkages between units.

In a still further aspect, the present invention provides an isolated regulatory element capable of causing expression of an exogenous gene in plant cells. Preferably the regulatory element is isolated from a nucleic acid or nucleic acid fragment encoding OMT, 4CL, CCR or CAD.

The regulatory element may be a nucleic acid molecule, including DNA (such as cDNA or genomic DNA) and RNA (such as mRNA) that is single- or double-stranded, optionally containing synthetic, non-natural or altered nucleotide bases, and combinations thereof.

Preferably the regulatory element includes a promoter, more preferably an 0-methyltransferase promoter, even more preferably an 0-methyltransferase promoter from a ryegrass (*Lolium*) or fescue (*Festuca*) species, more preferably a ryegrass, most preferably perennial ryegrass (*Lolium perenne*).

In a particularly preferred embodiment of this aspect of the invention, the regulatory element includes a promoter from the caffeic acid 0-methyltransferase gene corresponding to the cDNA homologue LpOMT1 from perennial ryegrass.

Preferably the regulatory element includes a nucleotide sequence including the first approximately 4630 nucleotides of the sequence shown in FIG. 18 hereto (Sequence ID No: 13); or a functionally active fragment or variant thereof.

By "functionally active" in this context is meant that the fragment or variant (such as an analogue, derivative or mutant) is capable of causing expression of a transgene in plant cells. Such variants include naturally occurring allelic variants and non-naturally occurring variants. Additions, deletions, substitutions and derivatizations of one or more of the nucleotides are contemplated so long as the modifications do not result in loss of functional activity of the regulatory element. Preferably the functionally active fragment or variant has at least approximately 80% identity to the relevant part of the above sequence, more preferably at least approximately 90% identity, most preferably at least approximately 95% identity. Preferably the fragment has a size of at least 100 nucleotides, more preferably at least 150 nucleotides, most preferably at least 200 nucleotides.

In a particularly preferred embodiment of this aspect of the invention, the regulatory element includes a nucleotide sequence selected from the group consisting of:

Nucleotides −4581 to −1
Nucleotides −4285 to −1
Nucleotides −4020 to −1
Nucleotides −2754 to −1
Nucleotides −1810 to −1
Nucleotides −831 to −1
Nucleotides −560 to −1
Nucleotides −525 to −1
Nucleotides −274 to −1
Nucleotides −21 to −1
of FIG. 18 hereto (Sequence ID No: 13);
or a functionally active fragment or variant thereof.

In another preferred embodiment the regulatory element includes a 4 coumarate-CoA ligase promoter, even more preferably a 4 coumarate-CoA ligase promoter from a ryegrass (*Lolium*) or fescue (*Festuca*) species, more preferably a ryegrass, most preferably perennial ryegrass (*Lolium perenne*).

In a particularly preferred embodiment of this aspect of the invention, the regulatory element includes a promoter from the 4 coumarate-CoA ligase gene corresponding to the cDNA homologue Lp4CL2 from perennial ryegrass.

Preferably the regulatory element includes a nucleotide sequence including the first approximately 2206 nucleotides of the sequence shown in FIG. 38 hereto (Sequence ID No: 17); or a functionally active fragment or variant thereof.

By "functionally active" in this context is meant that the fragment or variant (such as an analogue, derivative or mutant) is capable of causing expression of a transgene in plant cells. Such variants include naturally occurring allelic variants and non-naturally occurring variants. Additions, deletions, substitutions and derivatizations of one or more of the nucleotides are contemplated so long as the modifications do not result in loss of functional activity of the regulatory element. Preferably the functionally active fragment or variant has at least approximately 80% identity to the relevant part of the above sequence, more preferably at least approximately 90% identity, most preferably at least approximately 95% identity. Preferably the fragment has a size of at least 100 nucleotides, more preferably at least 150 nucleotides, most preferably at least 200 nucleotides.

In a particularly preferred embodiment of this aspect of the invention, the regulatory element includes a nucleotide sequence selected from the group consisting of:

Nucleotides −2206 to −1
Nucleotides −1546 to −1
Nucleotides −1186 to −1
Nucleotides −406 to −1
Nucleotides −166 to −1
of FIG. 38 hereto (Sequence ID No: 17);
or a functionally active fragment or variant thereof.

In another preferred embodiment the regulatory element includes a cinnamoyl-CoA reductase promoter, even more preferably a cinnamoyl-CoA reductase promoter from a ryegrass (*Lolium*) or fescue (*Festuca*) species, more preferably a ryegrass, most preferably perennial ryegrass (*Lolium perenne*).

In a particularly preferred embodiment of this aspect of the invention, the regulatory element includes a promoter from the cinnamoyl-CoA reductase gene corresponding to the LpCCR1 cDNA from perennial ryegrass.

Preferably the regulatory element includes a nucleotide sequence including the first approximately 6735 nucleotides of the sequence shown in FIG. 39 hereto (Sequence ID No: 18); or a functionally active fragment or variant thereof.

By "functionally active" in this context is meant that the fragment or variant (such as an analogue, derivative or mutant) is capable of causing expression of a transgene in plant cells. Such variants include naturally occurring allelic variants and non-naturally occurring variants. Additions, deletions, substitutions and derivatizations of one or more of the nucleotides are contemplated so long as the modifications do not result in loss of functional activity of the regulatory element. Preferably the functionally active fragment or variant has at least approximately 80% identity to the relevant part of the above sequence, more preferably at least approximately 90% identity, most preferably at least approximately 95% identity. Preferably the fragment has a size of at least 100 nucleotides, more preferably at least 150 nucleotides, most preferably at least 200 nucleotides.

In a particularly preferred embodiment of this aspect of the invention, the regulatory element includes a nucleotide sequence selected from the group consisting of:

Nucleotides −6735 to −1
Nucleotides −5955 to −1
Nucleotides −5415 to −1
Nucleotides −4455 to −1
Nucleotides −4035 to −1
Nucleotides −3195 to −1
Nucleotides −2595 to −1
Nucleotides −1755 to −1
Nucleotides −1275 to −1
Nucleotides −495 to −1
Nucleotides −255 to −1
Nucleotides −75 to −1
of FIG. 39 hereto (Sequence ID No: 18);
or a functionally active fragment or variant thereof.

By an "exogenous gene" is meant a gene not natively linked to said regulatory element. In certain embodiments of the present invention the exogenous gene is also not natively found in the relevant plant or plant cell.

The exogenous gene may be of any suitable type. The exogenous gene may be a nucleic acid such as DNA (e.g. cDNA or genomic DNA) or RNA (e.g. mRNA), and combinations thereof. The exogenous gene may correspond to a target gene, for example a gene capable of influencing disease resistance, herbage digestibility, nutrient quality, mineral content or drought tolerance or be a fragment or variant (such as an analogue, derivative or mutant) thereof which is capable of modifying expression of said target gene. Such variants include nucleic acid sequences which are antisense to said target gene or an analogue, derivative, mutant or fragment thereof. The transgene may code for a protein or RNA sequence depending the target condition and whether down or up-regulation of gene expression is required. Preferably, the target gene is selected from exogenous coding sequences coding for mRNA for a protein, this protein may be of bacterial origin (such as enzymes involved in cell wall modification and cell wall metabolism, cytokinin biosynthesis), or eukaryotic origin (such as pharmaceutically active polypeptides) or of plant origin (such as enzymes involved in the synthesis of phenolic compounds, cell wall metabolism, sugar metabolism, lignin biosynthesis). Preferably, the target gene is selected from the group comprising 0-methyltransferase, 4 coumarate CoA-ligase, cinnamoyl CoA reductase, cinnamyl alcohol dehydrogenase, cinnamate 4 hydroxylase, phenolase, laccase, peroxidase, coniferol glucosyl transferase, coniferin beta-glucosidase, phenylalanine ammonia lyase, ferulate 5-hydroxylase, chitinase, glucanase, isopentenyltransferase, xylanase.

The plant cells, in which the regulatory element of the present invention is capable of causing expression of an exogenous gene, may be of any suitable type. The plant cells may be from monocotyledons (such as grasses from the genera *Lolium, Festuca, Cynodon, Bracharia, Paspalum, Panicum, Miscanthus, Pennisetum, Phalaris*, and other forage and turf grasses, corn, grains, oat, sugarcane, wheat and barley), dicotyledons (such as *Arabidopsis*, tobacco, legumes, Alfalfa, oak, *Eucalyptus*, maple, *Populus*, canola, soybean and chickpea) and gymnosperms (such as *Pinus*). Preferably the plant cells are from a monocotyledon, more preferably a grass species such as *Lolium, Festuca, Cynodon, Bracharia, Paspalum, Panicum, Miscanthus, Pennisetum, Phalaris*, and other forage, turf and bioenergy grasses, more preferably a *Lolium* species such as *Lolium perenne* or *Lolium arundinaceum*.

The regulatory element according to the present invention may be used to express exogenous genes to which it is operatively linked in the production of transgenic plants.

Accordingly, in a further aspect of the present invention there is provided a vector including a regulatory element according to the present invention.

In a preferred embodiment of this aspect of the invention, the vector may include a regulatory element according to the present invention, an exogenous gene as hereinbefore described, and a terminator; said regulatory element, exogenous gene and terminator being operatively linked, such that said regulatory element is capable of causing expression of said exogenous gene in plant cells. Preferably, said regulatory element is upstream of said exogenous gene and said terminator is downstream of said exogenous gene.

The vector may be of any suitable type and may be viral or non-viral. The vector may be an expression vector. Such vectors include chromosomal, non-chromosomal and synthetic nucleic acid sequences, e.g. derivatives of plant viruses; bacterial plasmids; derivatives of the Ti plasmid from *Agrobacterium tumefaciens*; derivatives of the Ri plasmid from *Agrobacterium rhizogenes*; phage DNA; yeast artificial chromosomes; bacterial artificial chromosomes; binary bacterial artificial chromosomes; vectors derived from combinations of plasmids and phage DNA. However, any other vector may be used as long as it is replicable on integrative or viable in the plant cell.

The terminator may be of any suitable type and includes for example polyadenylation signals, such as the Cauliflower Mosaic Virus 35S polyA (CaMV 35S polyA) and other terminators from the nopaline synthase (nos) and the octopine synthase (ocs) genes.

The vector, in addition to the regulatory element, the exogenous nucleic acid and the terminator, may include further elements necessary for expression of the nucleic acid, in different combinations, for example vector backbone, origin of replication (ori), multiple cloning sites, spacer sequences, enhancers, *intrans* (such as the maize Ubiquitin Ubi intron), antibiotic resistance genes and other selectable marker genes [such as the neomycin phosphotransferase (npt2) gene, the hygromycin phosphotransferase (hph) gene, the phosphinothricin acetyltransferase (bar or pat) gene], and reporter genes (such as beta-glucuronidase (GUS) gene (gusA)]. The vector may also contain a ribosome binding site for translation initiation. The vector may also include appropriate sequences for amplifying expression.

The regulatory element of the present invention may also be used with other full promoters or partial promoter elements.

As an alternative to use of a selectable marker gene to provide a phenotypic trait for selection of transformed host cells, the presence of the vector in transformed cells may be determined by other techniques well known in the art, such as PCR (polymerase chain reaction), Southern blot hybridisation analysis, histochemical GUS assays, northern and Western blot hybridisation analyses.

Those skilled in the art will appreciate that the various components of the vector are operatively linked, so as to result in expression of said transgene. Techniques for operatively linking the components of the vector of the present invention are well known to those skilled in the art. Such techniques include the use of linkers, such as synthetic linkers, for example including one or more restriction sites.

The vectors of the present invention may be incorporated into a variety of plants, including monocotyledons, dicotyledons and gymnosperms. In a preferred embodiment the vectors are used to transform monocotyledons, preferably grass species such as ryegrasses (*Lolium* species) and fescues (*Festuca* species), more preferably perennial ryegrass (*Lolium perenne*) including cultivars for forage and turf applications.

Techniques for incorporating the vectors of the present invention into plant cells (for example by transduction, transfection or transformation) are well known to those skilled in the art. Such techniques include *Agrobacterium* mediated introduction, electroporation to tissues, cells and protoplasts, protoplast fusion, injection into reproductive organs, injection into immature embryos and high velocity projectile introduction to cells, tissues, calli, immature and mature embryos. The choice of technique will depend largely on the type of plant to be transformed.

Cells incorporating the vector of the present invention may be selected, as described above, and then cultured in an appropriate medium to regenerate transformed plants, using techniques well known in the art. The culture conditions, such as temperature, pH and the like, will be apparent to the person skilled in the art. The resulting plants may be reproduced, either sexually or asexually, using methods well known in the art, to produce successive generations of transformed plants.

In a further aspect of the present invention there is provided a plant cell, plant, plant seed or other plant part, including, e.g. transformed with, a vector of the present invention.

The plant cell, plant, plant seed or other plant part may be from any suitable species, including monocotyledons, dicotyledons and gymnosperms. In a preferred embodiment the plant cell, plant, plant seed or other plant part is from a monocotyledon, preferably a grass species, more preferably a ryegrass (*Lolium* species) or fescue (*Festuca* species), even more preferably perennial ryegrass (*Lolium perenne*), including cultivars for forage and turf applications.

The present invention also provides a plant, plant seed, or other plant part derived from a plant cell of the present invention.

The present invention also provides a plant, plant seed or other plant part derived from a plant of the present invention.

In a still further aspect of the present invention there is provided a recombinant plant genome including a regulatory element according to the present invention.

In a preferred embodiment of this aspect of the invention the recombinant plant genome further includes an exogenous gene operatively linked to said regulatory element.

In a further aspect of the present invention there is provided a method for expressing an exogenous gene in plant cells, said method including introducing into said plant cells an effective amount of a regulatory element and/or a vector according to the present invention.

By "an effective amount" is meant an amount sufficient to result in an identifiable phenotypic change in said plant cells or a plant, plant seed or other plant part derived therefrom. Such amounts can be readily determined by an appropriately skilled person, taking into account the type of plant cell, the route of administration and other relevant factors. Such a person will readily be able to determine a suitable amount and method of administration. See, for example, Maniatis et al, Molecular Cloning: A Laboratory Manual, Cold Spring Harbor Laboratory, Cold Spring Harbor, the entire disclosure of which is incorporated herein by reference.

The present invention will now be more fully described with reference to the accompanying Examples and drawings. It should be understood, however, that the description following is illustrative only and should not be taken in any way as a restriction on the generality of the invention described above.

In the Figures

FIG. 2 shows the nucleotide (Sequence ID No: 1) and amino acid (Sequence ID No: 2) sequences of Lp4CL1.

FIG. 3 shows the nucleotide (Sequence ID No: 3) and amino acid (Sequence ID No: 4) sequences of Lp4CL2.

FIG. 4 shows the nucleotide (Sequence ID No: 5) and amino acid (Sequence ID No: 6) sequences of Lp4CL3.

FIG. 5 shows amino acid sequence alignment of deduced proteins encoded by Lp4CL1 (Sequence ID No: 2), Lp4CL2 (Sequence ID No: 4) and Lp4CL3 (Sequence ID No: 6).

Figure 6:
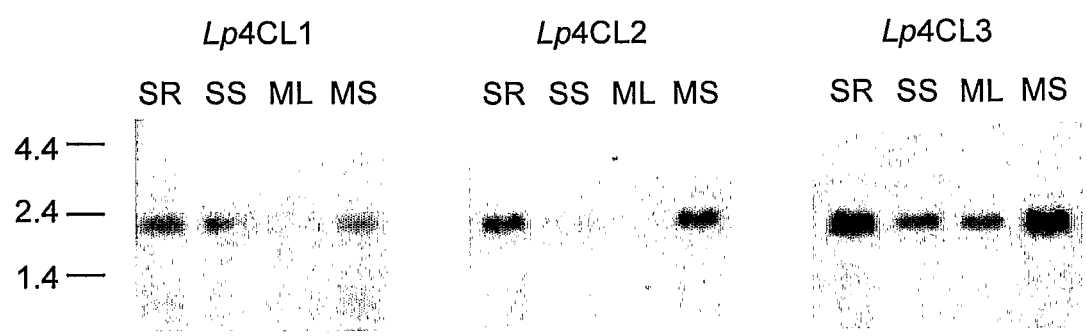

FIG. 6 shows northern hybridisation analysis of developing perennial ryegrass using Lp4CL1, Lp4CL2 and Lp4CL3 as hybridisation probes. SR: roots from seedlings (3-5 d post-germination), SS: shoots from seedlings (3-5 d post-germination), ML: leaves from 12-week-old plants, MS: stems from 12-week-old plants. Blots were washed in 0.2× SSPE, 0.1% SOS at 65° C. Lp4CL1, Lp4CL2 and Lp4CL3 do not cross hybridise at this stringency. Sizes are given in kb.

Figure 7:
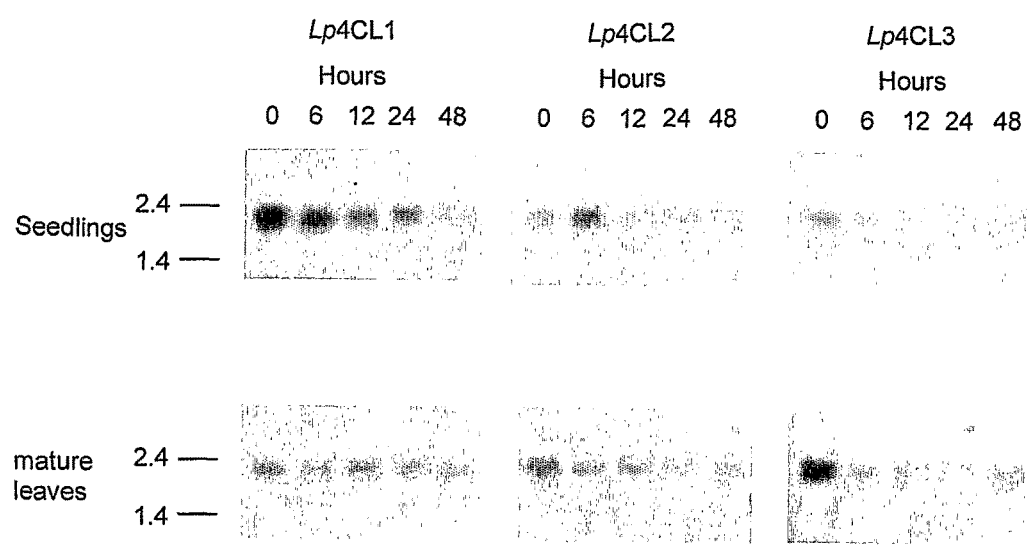

FIG. 7 shows northern hybridisation analysis showing the time course of expression of 4CL mRNA in wounded perennial ryegrass leaves. Sizes are given in kb.

Figure 8:
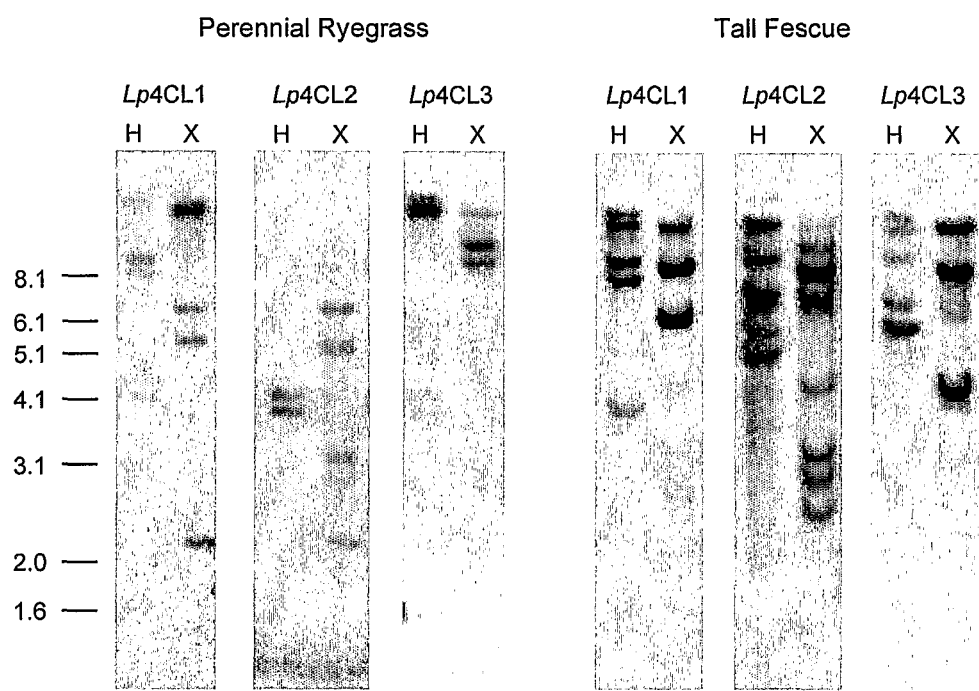

FIG. 8 shows genomic Southern hybridisation analysis using Lp4CL1, Lp4CL2 and Lp4CL3 as hybridisation probes. 10 μg of digested perennial ryegrass genomic DNA or 20 μg of digested tall fescue genomic DNA were separated on a 1.0% agarose gel, transferred to Hybond N+ membranes and then hybridised with $^{32}$P labelled Lp4CL1, Lp4CL2 or Lp4CL3 probes. The ryegrass Lp4CL1, Lp4CL2 and Lp4CL3 genes reveal homologous sequences in tall fescue and indicate that the ryegrass 4CL genes can be used to isolate and to manipulate the expression of the tall fescue (*Festuca arundinacea*) 4CL genes.

Figure 9:
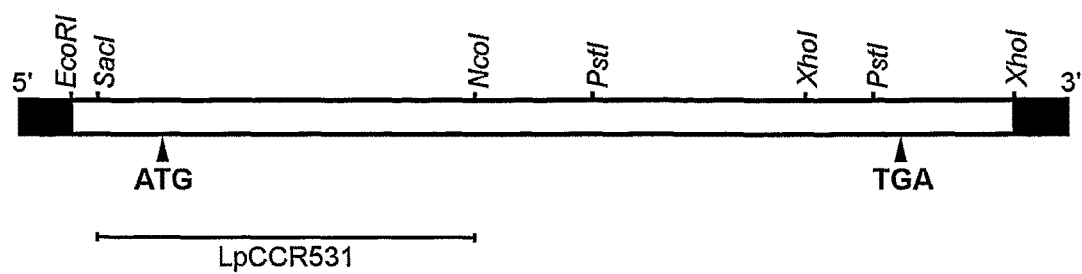

FIG. 9 shows restriction map of LpCCR1. An *L. perenne* seedling cDNA library constructed in Uni-ZAP™ (Stratagene) was screened in a solution containing 10×PIPES, 50% deionised formamide and 10% SDS at 42° C. Filters were washed at room temperature, three times in 0.1% SDS, 2×SSPE and then twice in 0.1% SDS, 0.2×SSPE. The location of the probe used for northern and Southern hybridisation analyses is indicated by the black line labelled LpCCR531.

FIG. 10 shows the nucleotide (Sequence ID No: 7) and amino acid (Sequence ID No: 8) sequences of LpCCR1.

Figure 11:
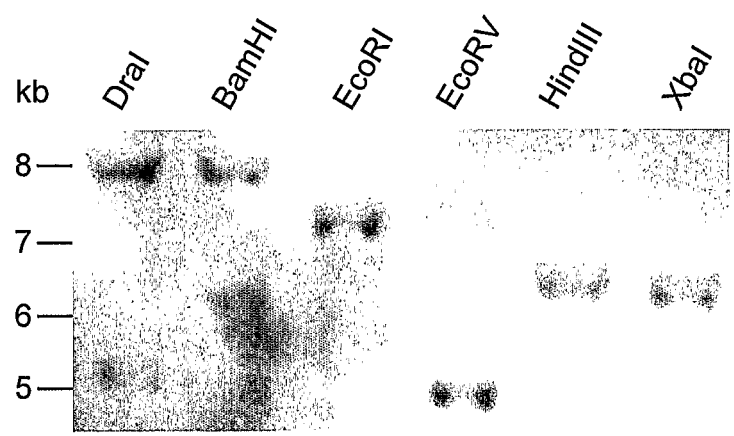

FIG. 11 shows Southern hybridisation analysis of DNA from double haploid (DH) perennial ryegrass using LpCCR1 as hybridisation probe. 10 μg of DH genomic DNA was digested with Oral, BamHI, EcoRI, EcoRV, HindIII or XbaI, separated on a 1% agarose gel and then capillary blotted onto nylon membrane (Amersham Hybond-N). The membrane was probed with the digoxigenin (DIG) labelled LpCCR531 fragment at 25 ng/ml in the hybridisation solution. Hybridisation was in 4×SSC, 50% formamide, 0.1% N-Lauroyl-sarcosine, 0.02% SDS, 2% Blocking solution at 42° C. The membrane was washed twice for five minutes in 2×SSC, 0.1% SDS at room temperature, then twice for fifteen minutes in 0.5×SSC, 0.1% SOS at 68° C. Molecular weight was determined by comparison to a DIG-labelled marker (Roche Molecular Biochemicals).

Figure 12:
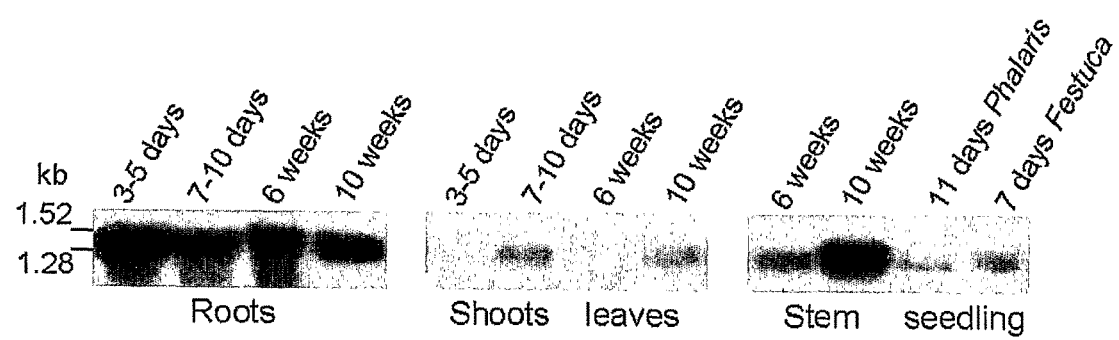

FIG. 12 shows northern hybridisation analysis of RNA samples from different organs and developmental stages of perennial ryegrass using LpCCR1 probe. Roots from seedlings (3-5 d post-germination), shoots from seedlings (3-5 d post-germination), roots from seedlings (7-10 d post-germination), leaves from seedlings (7-10 d post-germination), roots from 6 and 10 week old plants, leaves from 6 and 10 week old plants, stems from 6 and 10 week old plants, whole seedling from 11 day old *Phalaris* and 7 day old *Festuca*.

Total RNA was isolated using Trizol (GibcoBRL) and 15 μg was separated on a 1.2% Agarose gel containing 6% formamide and then capillary blotted onto nylon membrane (Amersham Hybond-N). The membrane was stained with 0.2% methylene blue/0.3M sodium acetate to visualise the marker and ensure that RNA was evenly loaded. 50 ng LpCCR531 was random-labelled with $^{32}$P-dCTP (Amersham Megaprime) and hybridisation conditions were 4×SSC, 50% formamide, 0.5% SOS, 5×denhardt solution, 5% dextrane sulphate, 0.1% Herring sperm DNA at 42° C. over-night. The ryegrass LpCCR1 gene reveal homologous transcripts in tall fescue and *Phalaris*, thus indicating that the ryegrass CCR gene can be used to manipulate the expression of the tall fescue (*Festuca arundinacea*) and *Phalaris* CCR endogenous genes.

FIG. 13 shows the nucleotide (Sequence ID No: 9) and amino acid (Sequence ID No: 10) sequences of LpCAD1.

FIG. 14 shows the nucleotide (Sequence ID No: 11) and amino acid (Sequence ID No: 12) sequences of LpCAD2.

Figure 15:
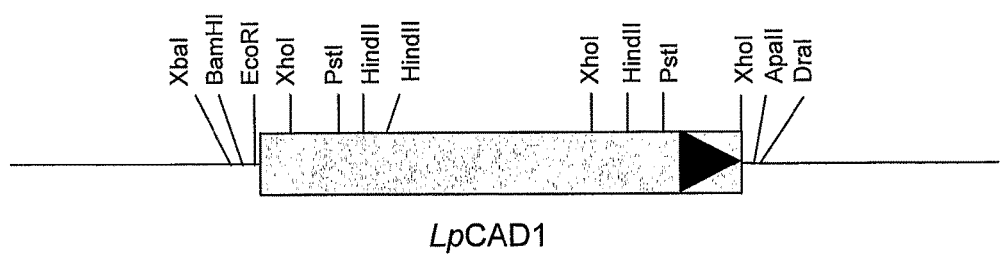

FIG. 15 shows a plasmid map of a cDNA clone encoding perennial ryegrass CAD homologue LpCAD1.

Figure 16:
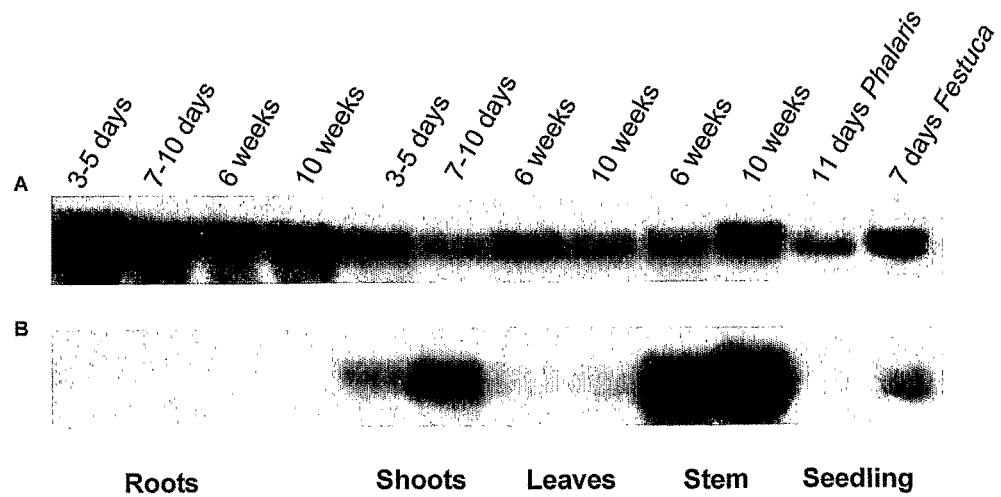

FIG. 16 shows northern hybridisation analysis of RNA samples from different organs and developmental stages of perennial ryegrass using A) LpCAD1 and B) LpCAD2 as hybridisation probes. Roots from seedlings 3-5 d post-germination, 7-10 d post-germination, 6 weeks and 10 weeks, Shoots from seedlings 3-5 d post-germination and 7-10 d post-germination, Leaves from 6 week old and 10 week old plants, stem tissue from 6 and 10 week old plants. RNA isolateq from *Phalaris* and *Festuca* 11 and 7 day old seedlings. The ryegrass CAD genes reveal homologous transcripts in tall fescue and *Phalaris*, thus indicating that the ryegrass CAD gene can be used to manipulate the expression of the tall fescue and *Phalaris* CAD endogenous genes.

Figure 17:
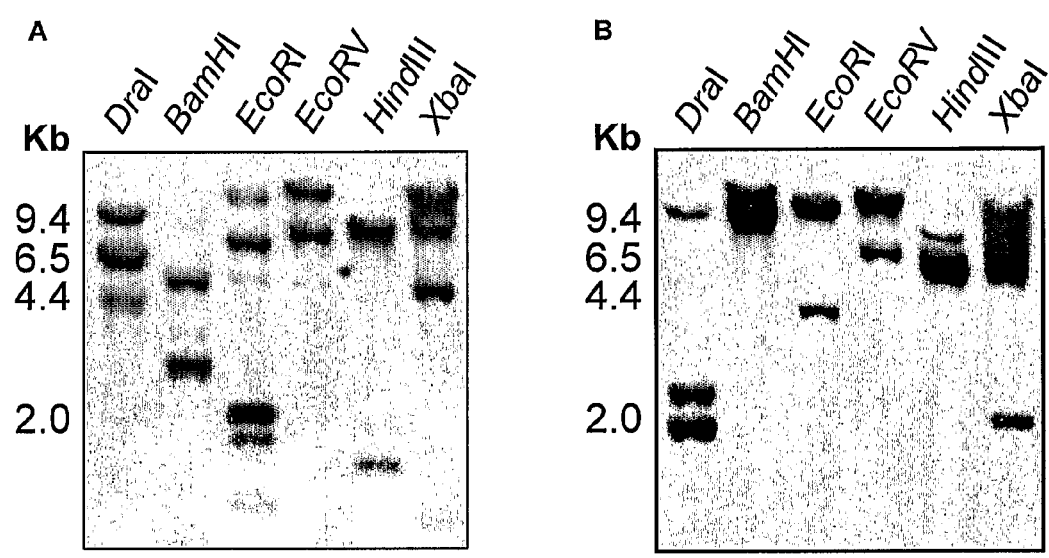

FIG. 17 shows genomic Southern hybridisation analysis. 10 μg of perennial ryegrass genomic DNA digested with a range of restriction enzymes was separated on a 0.8% agarose gel, transferred to Hybond N and then hybridised with a DIG labelled A) LpCAD1, and B) LpCAD2 hybridisation probe.

FIG. 18 shows the nucleotide sequence of the Lp0mt1 promoter (Sequence ID No: 13).

Figure 19:
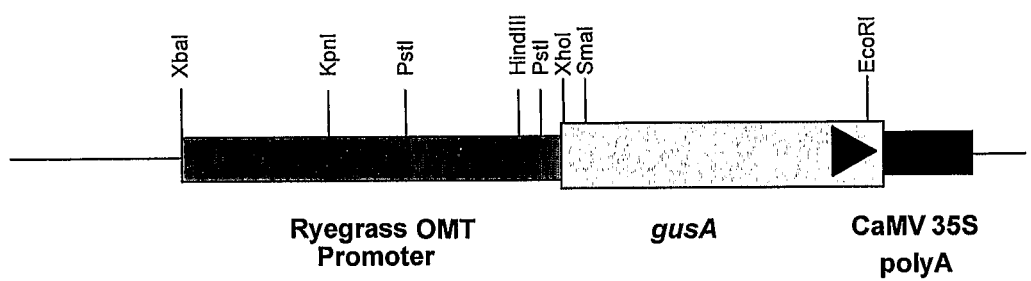

FIG. 19 shows a plasmid map of plant transformation vector carrying the reporter-glucuronidase (GUS) gene (gusA) under control of the perennial ryegrass Lp0mt1 promoter.

FIGS. 20 A and B show PCR analysis of transgenic tobacco plants containing the gusA gene under the control of the perennial ryegrass LpOMT1 promoter. PCR reactions using gusA-specific primers were performed. FIGS. 20 C and D show histochemical GUS assays, demonstrating xylem-specific gusA expression (A and B) and gusA expression in glandular leaf trichomes (C and D) in transgenic tobacco plants containing the gusA gene under the control of the perennial ryegrass LpOMT1 promoter.

FIG. 21 A-C show the isolation of the LpCCR 1 genomic clone 1. A) Southern hybridization analysis of CCR genomic clone 11,Lp6.1.1a digested with XbaI, NcoI, SalI, XhoI, XhoI/Sal1 DNA was separated on a 0.8% agarose gel, transferred to Hybond N and hybridized with a DIG labelled CCR1 probe. B) Map showing the genomic gene organisation of LpCCR1 clone 1 based on sequence results. C) Comparison of plant CCR exon size and number in different plant species (*Lolium perenne*, Lp., *Eucalyptus gunni*, Eg., *Eucalyptus saligna*, Es., *Populus balsamifera*, Pb.)

FIGS. 22 A and B show the isolation of the LpCCR1 genomic clone 2. A) Southern hybridization analysis of CCR genomic clone 11,Lp6.1.1a digested with XbaI, NcoI, SalI, XhoI, XhoI/Sal1 DNA was separated on a 0.8% agarose gel, transferred to Hybond N and hybridized with 200 bp of the CCR1 promoter (FIG. 21B). B) Map showing the promoter region of LpCCR1 clone 2 based on sequence results.

FIG. 23 A-C show the isolation of an Lp4CL genomic clone. A) Southern hybridisation analysis of 4CL genomic clone ALp4CL2 digested with 8amHI, KpnI or SalI. DNA was separated on a 0.8% agarose gel, transferred to Hybond N and hybridized with a DIG labelled 4CL1 hybridisation probe. B) 10 μl of a standard PCR reaction using forward and reverse oligonucleotides designed to positions outlined on C). The PCR products were separated on a 0.8% agarose gel and stained with ethidium bromide. C) Map showing the genomic gene organisation of ALp4CL2 based on sequence and PCR results.

FIG. 24 A-B show the isolation of an Lp4CL genomic clone. A) Southern hybridisation analysis of 4CL genomic clone ALp4CL2 digested with 8amHI, KpnI, SalI. DNA was separated on a 0.8% agarose gel, transferred to Hybond N and hybridized with a DIG labelled 4CL1 probe. B) Map showing the genomic gene organisation of Lp4CL2 clone 1 and the promoter region of clone 2.

Figure 25:
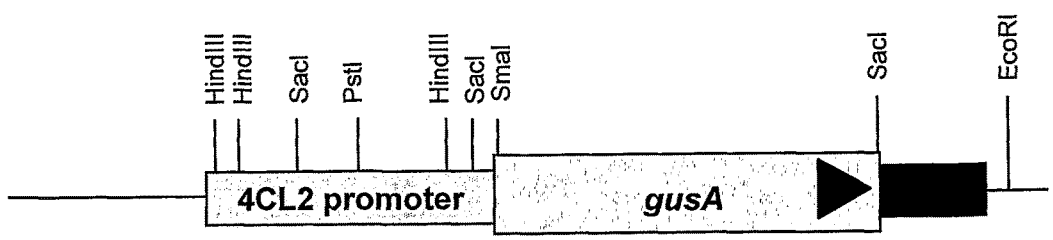

FIG. 25 shows plasmid map of plant transformation vector carrying the gusA gene under control of the perennial ryegrass Lp4CL2 promoter (Lp4CL2::gusA).

FIG. 26 shows nucleotide (Sequence ID No: 14) and amino acid (Sequence ID No: 15) sequences of genomic clone CAD2 cv 8arlano (Intron 1 and first 111 bp of the coding region are missing).

FIG. 27 shows nucleotide (Sequence ID No: 16) and amino acid (Sequence ID No:15) sequences of coding sequence deduced from genomic clone CAD2 cv 8arlano (region in bold is missing from the genomic clone).

FIG. 28 A-B show the isolation of LpCAD2 genomic clone. A) Southern hybridization analysis of CAD genomic clone ALpCAD2 digested with 8amHI, EcoRI, KpnI, SalI or XbaI. DNA was separated on a 0.8% agarose gel, transferred to Hybond N and hybridized with a DIG labelled CAD2 hybridisation probe. B) Map showing the genomic gene organisation of ALpCAD2 based on sequence results.

FIG. 29 A-B show A) Sense and antisense Lp4CL1, Lp4CL2 and Lp4CL3 transformation vectors under control of the CaMV 35S promoter; B) Sense and antisense Lp4CL1, Lp4CL2 and Lp4CL3 transformation vectors under control of the maize ubiquitin promoter.

Figure 30A:
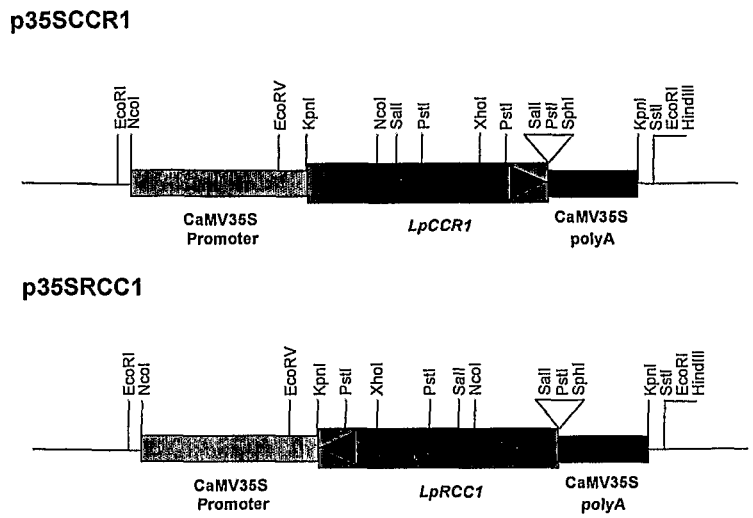
Figure 30B:
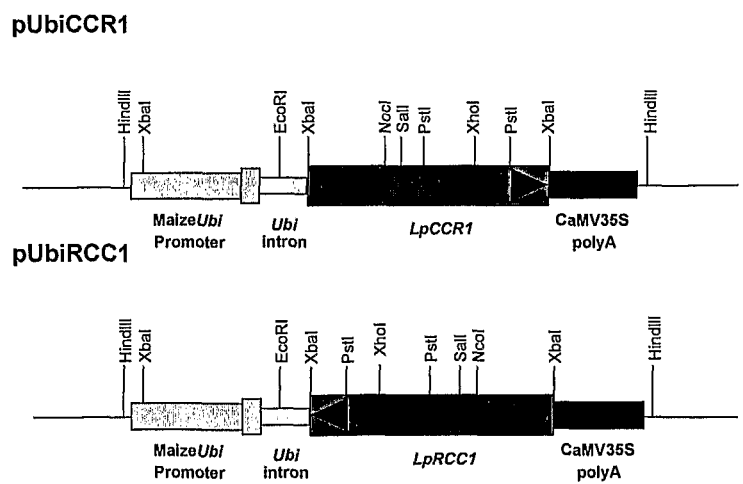
Figure 32A:
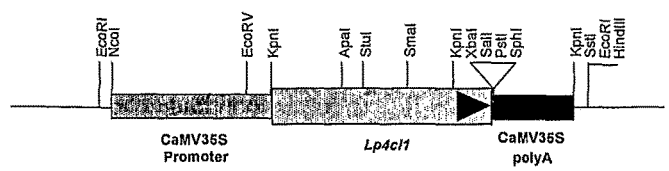
Figure 32B:
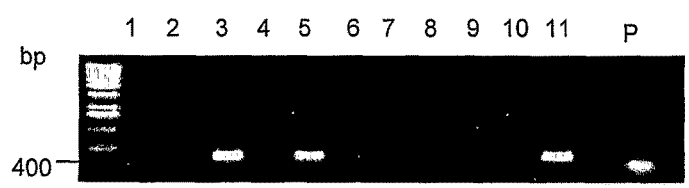
Figure 32C:
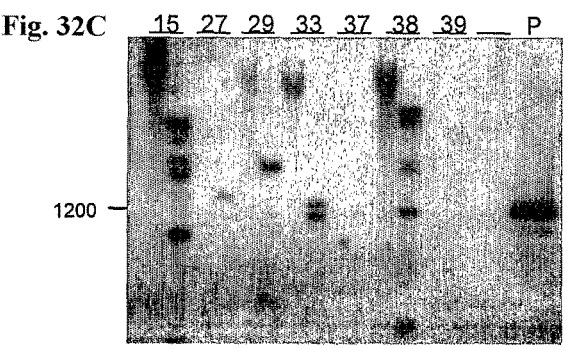
Figure 32D:
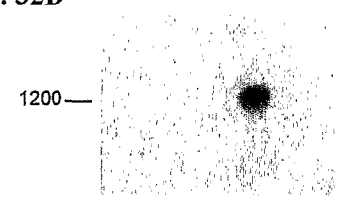

FIG. 30 A-B show A) Sense and antisense LpCCR1 transformation vectors under control of the CaMV 35S promoter; B) Sense and antisense LpCCR1 transformation vectors under control of the maize ubiquitin promoter.

FIG. 31 A-B show A) Sense and antisense LpCAD 1 transformation vectors under control of the CaMV 35S promoter; B) Sense and antisense LpCAD1 transformation vectors under control of the maize ubiquitin promoter.

FIG. 32 A-D show molecular analysis of Lp4CL1-transgenic tobacco. A) Plasmid map of transformation vector carrying a chimeric sense Lp4CL1 gene. B) PCR analysis of independent transgenic tobacco clones using Lp4CL1 specific primers. C) Southern hybridization analysis of independent transgenic tobacco plants using an Lp4CL1 specific probe. D) Northern hybridization analysis of independent transgenic tobacco plants using an Lp4CL1 specific probe.

Figure 33A:
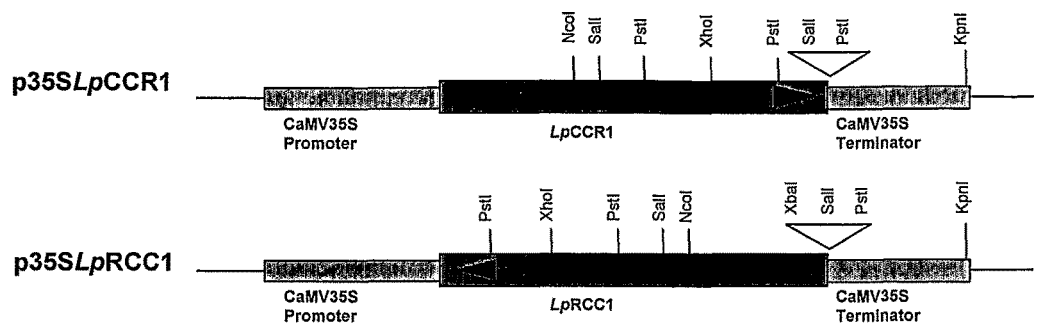
Figure 33B:
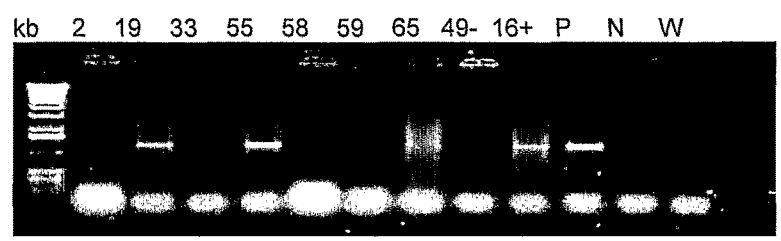
Figure 35A:
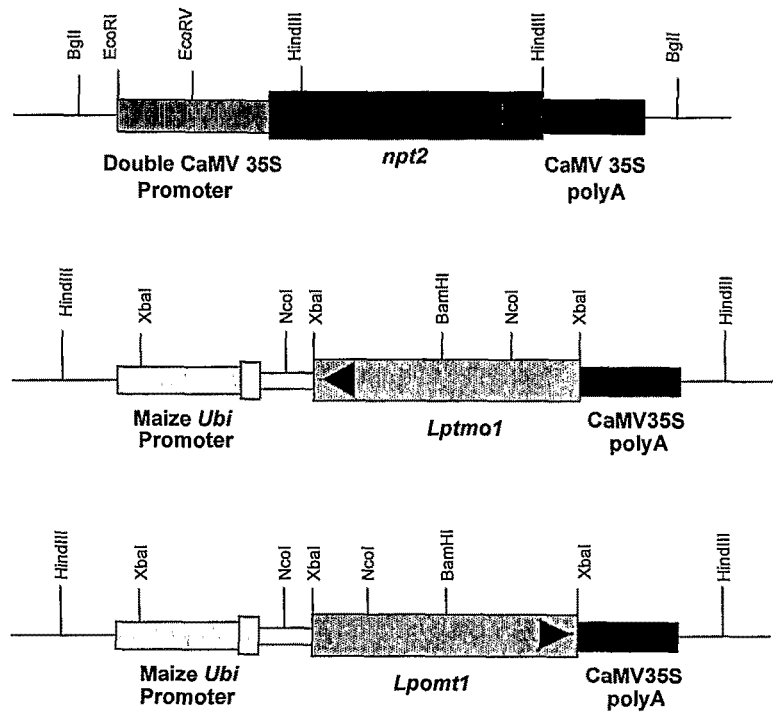
Figure 35B:
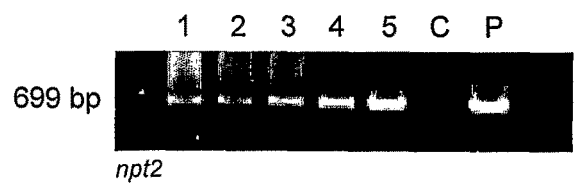
Figure 35C:
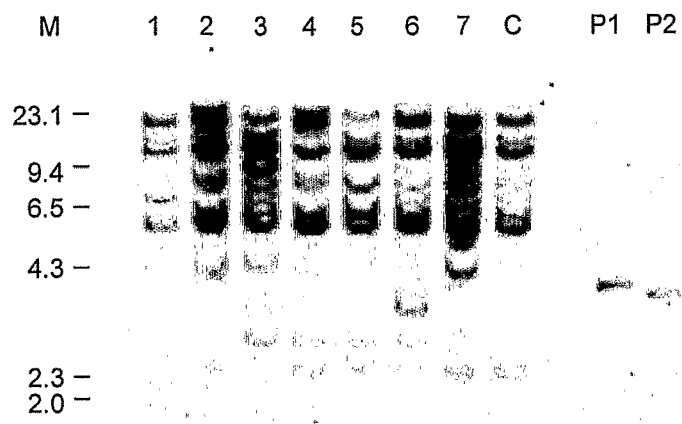
Figure 35D:
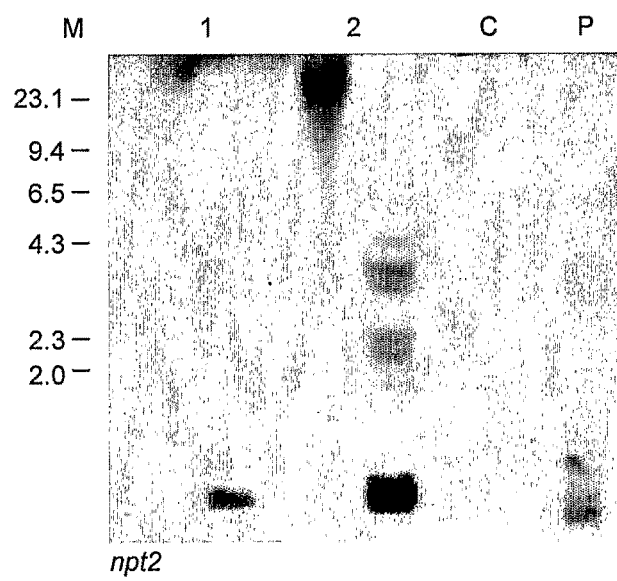
Figure 35E:
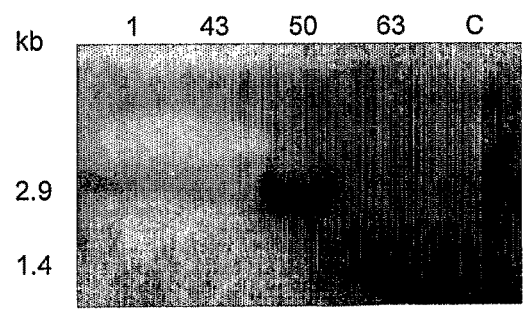

FIG. 33 A-B show molecular analysis of LpCCR1-transgenic tobacco. A) Plasmid map of transformation vectors carrying a chimeric sense and antisense LpCCR1 gene. B) PCR analysis of independent sense transgenic tobacco clones using LpCCR1 specific primers.

FIG. 34 A-H show protocol for suspension culture-independent production of transgenic perennial ryegrass plants. A) Isolated zygotic embryos, plated on MSM5 medium, day O; B) Embryogenic callus formation and proliferation, 6-8 weeks after embryo isolation; C) Embryogenic calli arranged on high osmotic MSM3Plus medium prior to biolistic transformation; D) Histochemical GUS assay showing GUS expressing foci 3-4 days post-bombardment of chimeric gusA gene; E) Selection of embryogenic calli on MSM3 medium containing 100 mg/l paromomycin (Pm), 2 weeks after microprojectile bombardment; F) Regeneration of Pm resistant shoots on MSK medium microprojectile bombardment; F) Regeneration of Pm resistant shoots on MSK medium containing 100 mg/l Pm, 4 weeks after microprojectile bombardment; G) In vitro plant regeneration from PM resistant embryogenic calli, 6 weeks after microprojectile bombardment; H) Transgenic perennial ryegrass plants 28 weeks after embryo isolation.

FIG. 35 A-E show molecular analysis of transgenic perennial ryegrass plants carrying sense and antisense Lp0mt1 transgenes. Plasmid maps of vectors used for the co-transformation of perennial ryegrass embryogenic calli; pHP23 carrying a chimeric neomycin phosphotransferase (npt2) selectable marker gene; pUbiomt1 carrying a maize ubiquitin promoter driven sense Lp0mt1 gene; pUbitmo1 carrying a maize ubiquitin PCR analysis using npt2-specific primers of 5 independent transgenic perennial ryegrass plants from biolistic transformation with sense and antisense Lp0mt1 vectors (upper centre). Southern hybridization analysis with an omt1 hybridization probe of 7 independent perennial ryegrass plants co-transformed with sense (lanes 1-3) and antisense (lanes 4-7) Lp0mt1 vectors (lower centre left). Southern hybridisation analysis with an npt2 hybridisation probe of independent perennial ryegrass plants (lower centre right). Northern hybridisation analysis of perennial ryegrass plants co-transformed with antisense Lp0mt1 vector (bottom). C=negative control untransformed perennial ryegrass; P=positive plasmid control.

Figure 36:
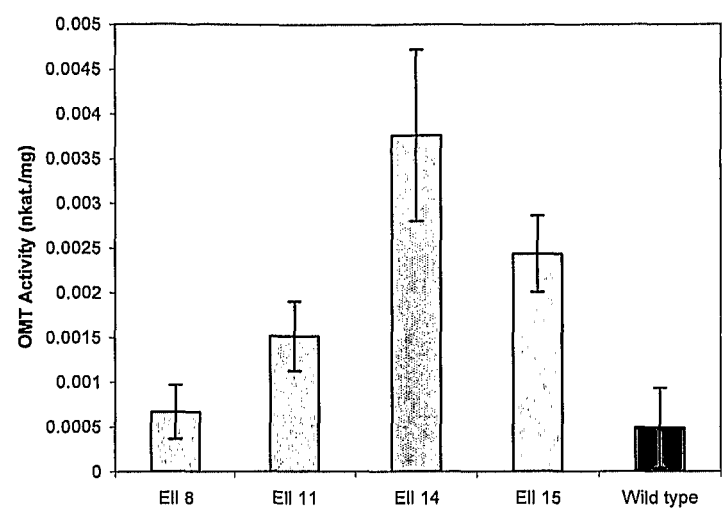

FIG. 36 shows biochemical analysis of Lp0mt1-transgenic perennial ryegrass. OMT activity of leaf samples from selected independent Lp0mt1-transgenic perennial ryegrass plants (Ell8, Ell11, Ell14 and Ell15) was determined and compared to untransformed perennial ryegrass negative control plant L. perenne cv. Ellett (wild type). Mean values and standard deviations of replicate assays are shown.

Figure 37:
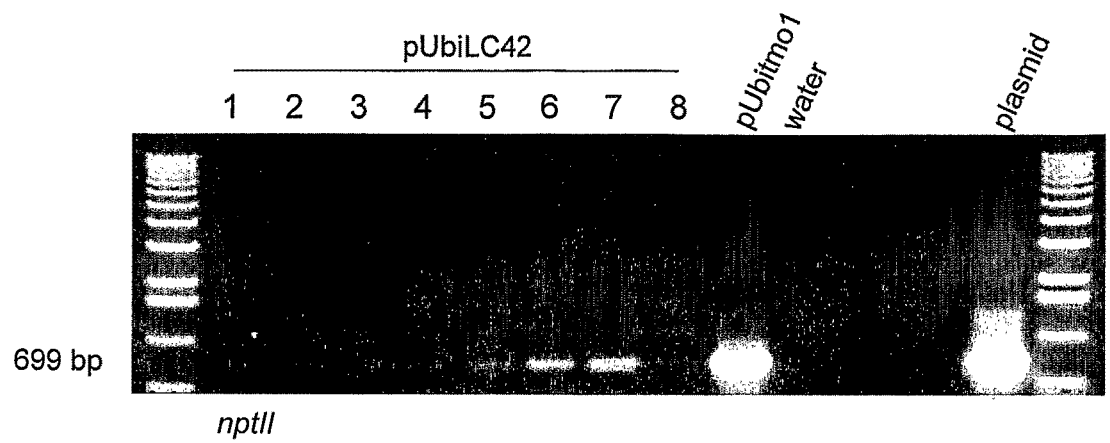

FIG. 37 shows PCR screening of transgenic ryegrass plants. PCR analysis using npt2-specific primers of 8 independent transgenic perennial ryegrass plants from biolistic transformation with antisense LpUbi4CL2 vector.

FIG. 38 shows the nucleotide sequence of genomic clone 4CL2 from perennial ryegrass (Sequence ID No: 17).

FIG. 39 shows the nucleotide sequence of genomic clone CCR1 from perennial ryegrass (Sequence ID No: 18).

Figure 40:
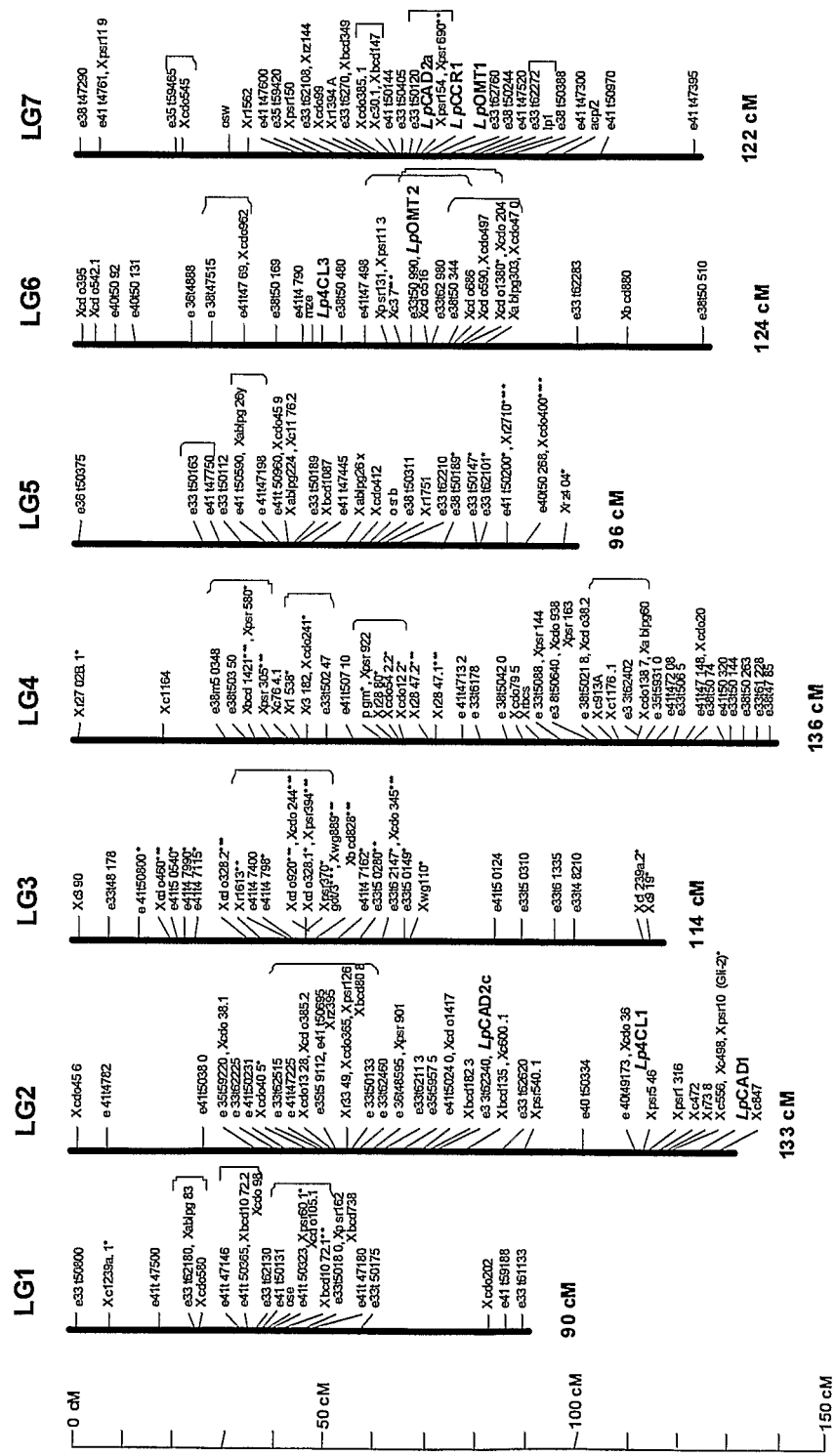

FIG. 40 shows the map location of Lp4CL1, Lp4CL3, LpCAD1, LpCAD2, LpCCR1, LpOMT1 and LpOMT2 (in bold) within the genetic linkage map of perennial ryegrass.

Figure 41:
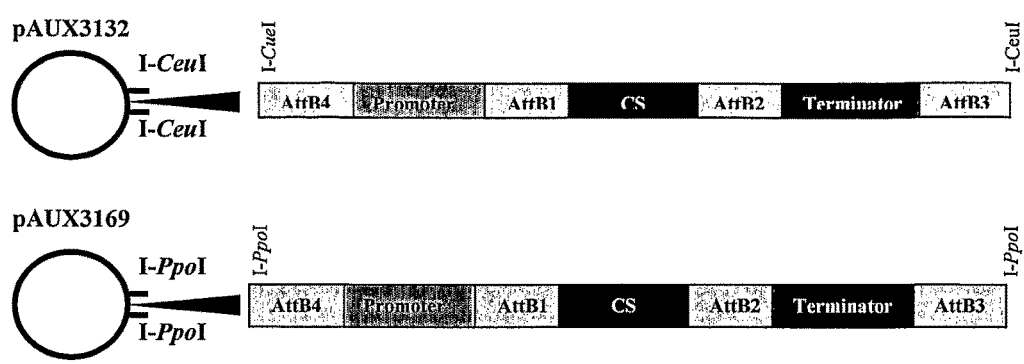

FIG. 41. Illustration of the Gateway-derived expression vectors used for generating the constructs for expressing perennial ryegrass lignin biosynthetic genes.

Figure 42:
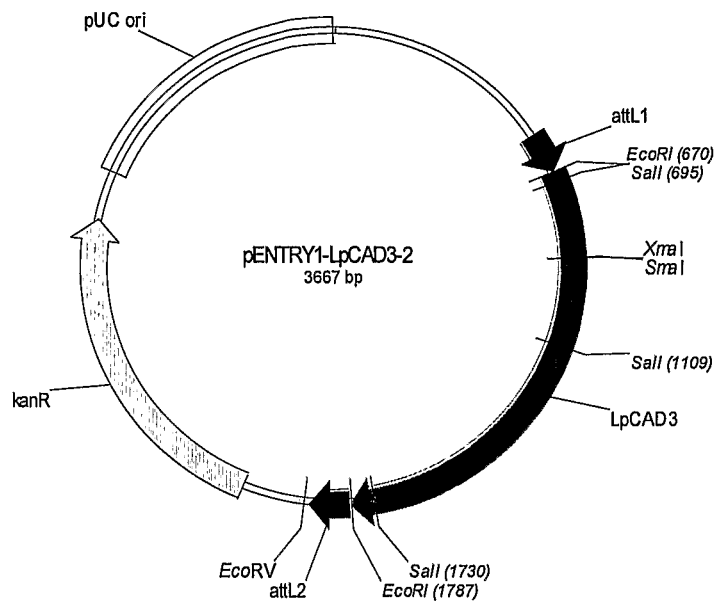

FIG. 42. Vector details of Gateway™ Entry clone for the LpCAD3 cDNA.

Figure 43:
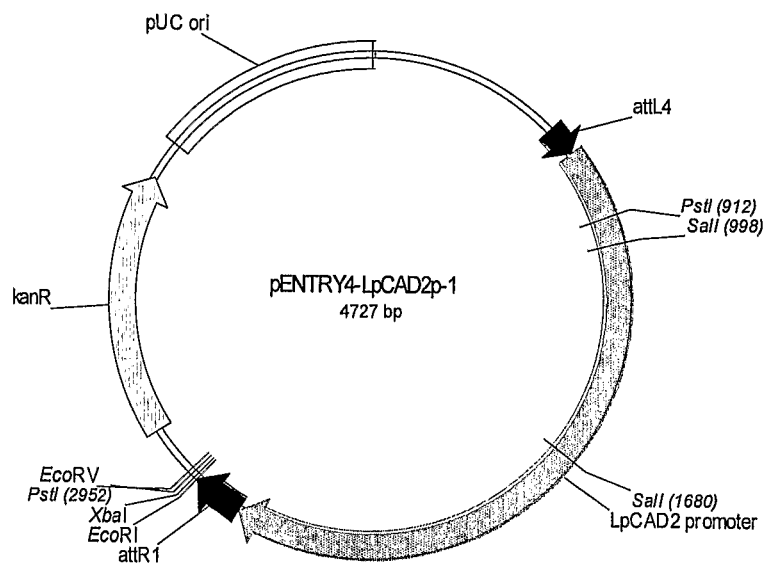

FIG. 43. Vector details of Gateway™ Entry clone for the promoter LpCAD2.

Figure 44:
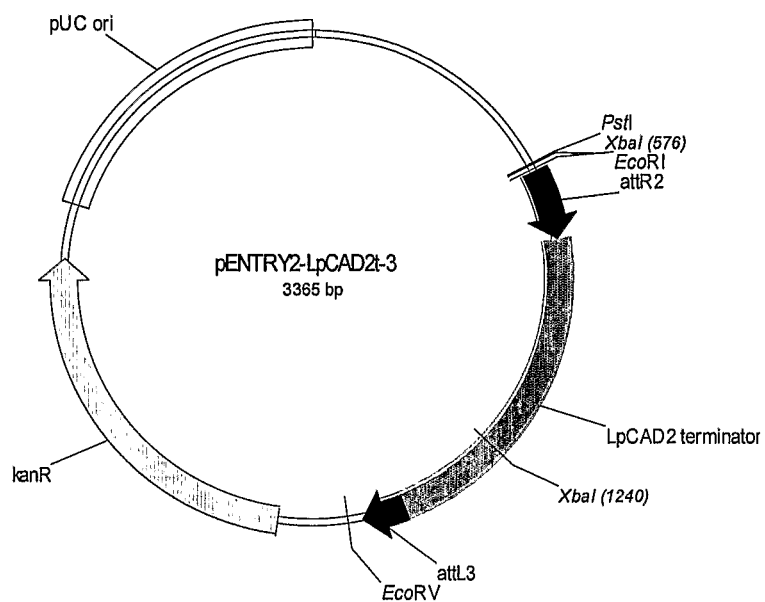

FIG. 44. Vector details of Gateway™ Entry clone for the terminator LpCAD2.

Figure 45:
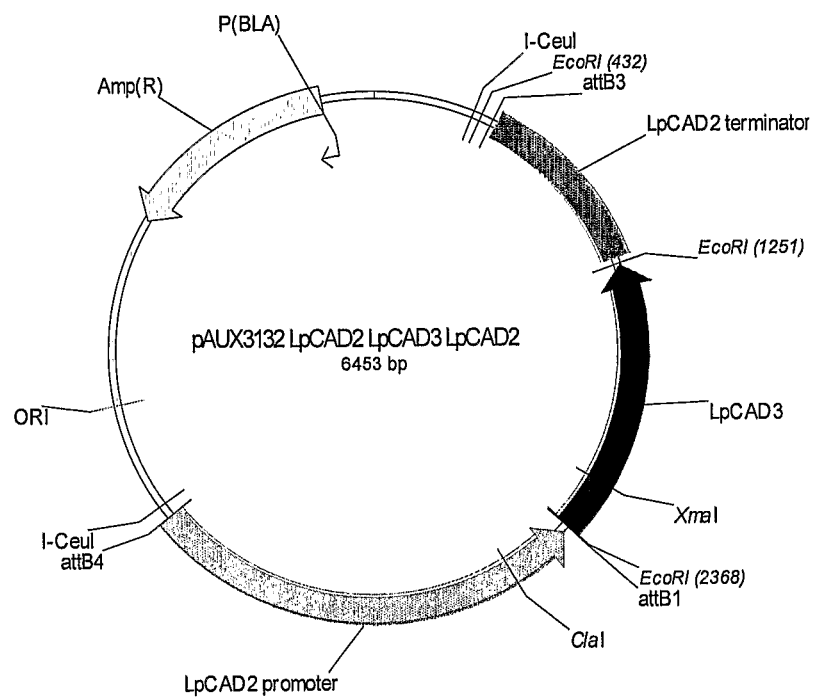

FIG. 45. Plasmid map of Construct 1, LpCAD2p::LpCAD3::LpCAD2t in vector pAUX3132.

Figure 46:
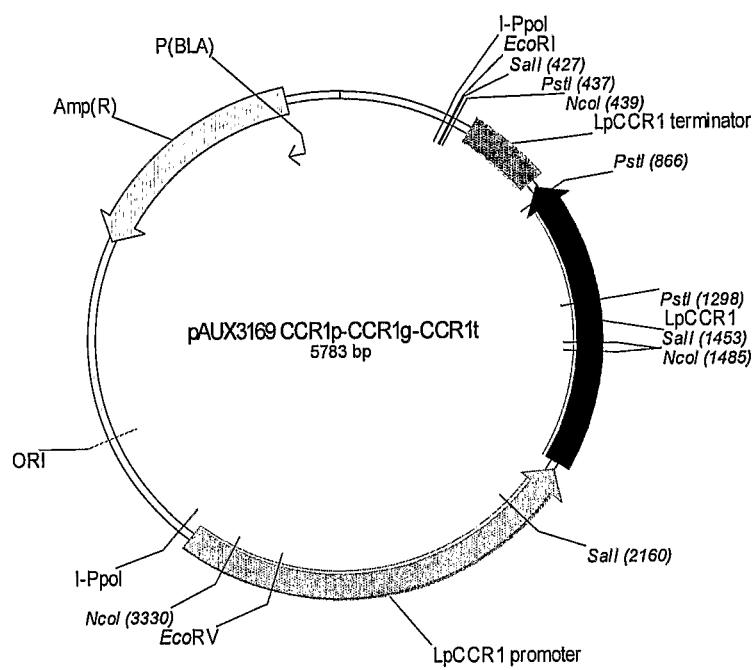

FIG. 46. Plasmid map of Construct 2, LpCCR1::LpCCR1::LpCCR1 in vector pAUX3169.

FIG. 47. Sequence of LpCCR1 gene (SEQ ID No: 19) and modified forward primer (SEQ ID No: 20) that imparts a single base deletion in the LpCCR1 gene.

Figure 48:
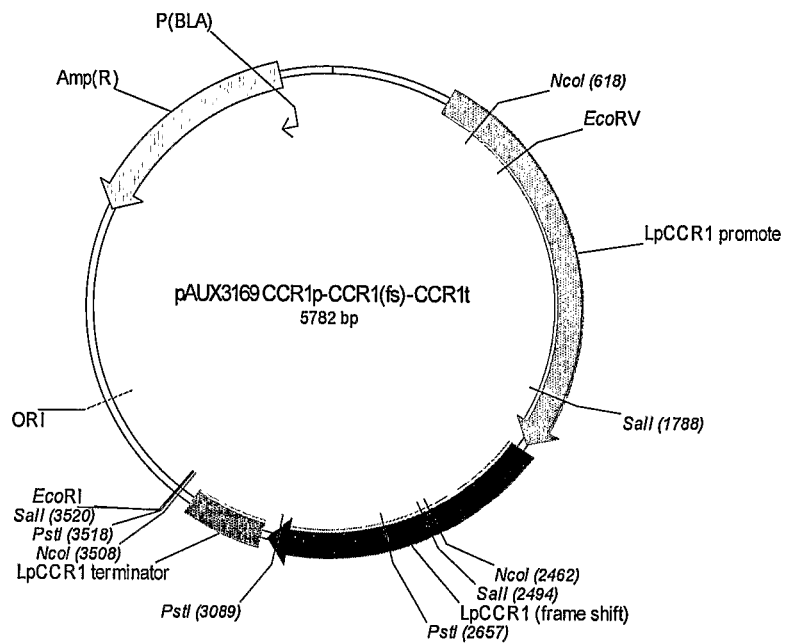

FIG. 48. Plasmid map of Construct 3, LpCCR1::LpCCR1 (fs)::LpCCR1 in vector pAUX3169.

Figure 49:
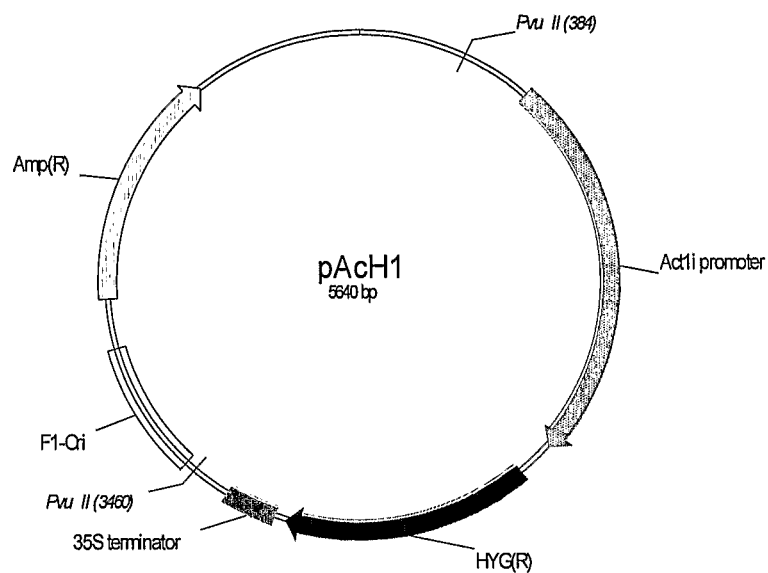

FIG. 49. Vector details for pAcH1 construct that was used as the plant selectable marker containing the expression construct Act1D::hph::35S.

Figure 50:
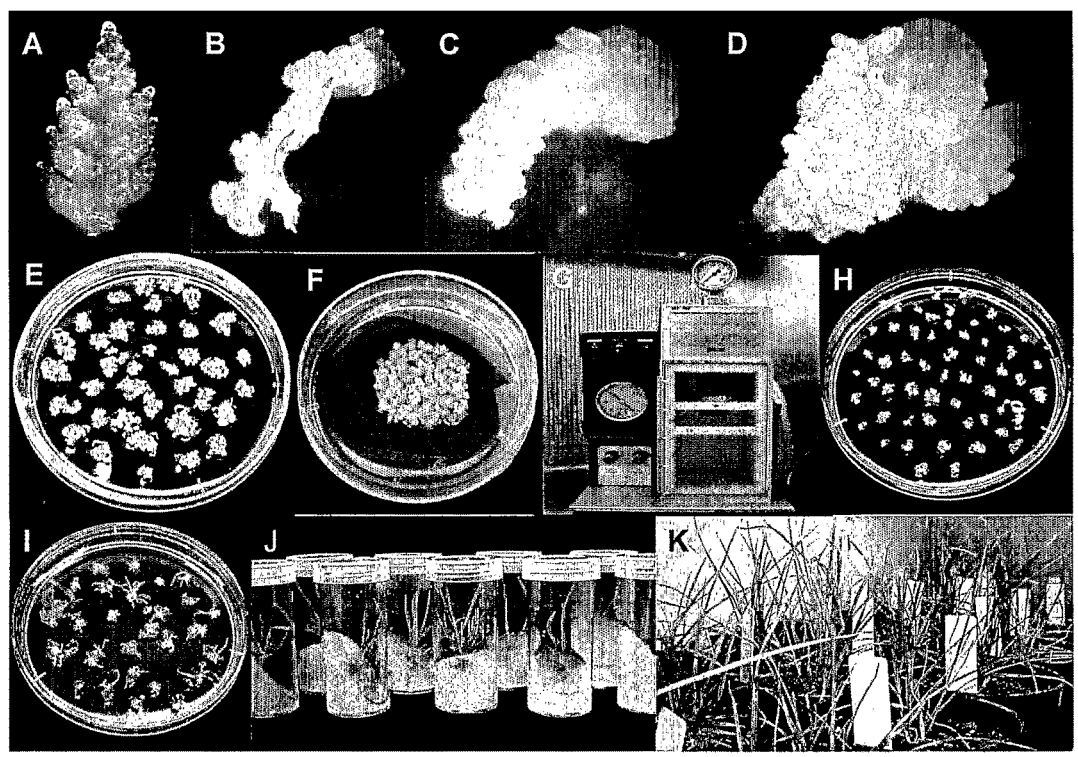

FIG. 50. Production of transgenic perennial ryegrass from microprojectile bombardment of embryogenic calli derived from immature inflorescences. A) Excised immature inflorescence of perennial ryegrass; 2-3 mm; B-E) Induction and proliferation of embryogenic calli; 1-8 weeks after inflorescence excision. F). Distribution of embryogenic calli on high osmotic medium LP3-0S medium prior to biolisitic transformation; G) Biolistic transformation device, PDS-1000/He; H-1) Growth and development of hygromycin-resistant shoots, 30-75 days post bombardment; J) Growth and development of hygromycin-resistant shoots in vitro; K) Hygromycin-resistant plants established in soil and grown under containment glasshouse conditions.

Figure 51:
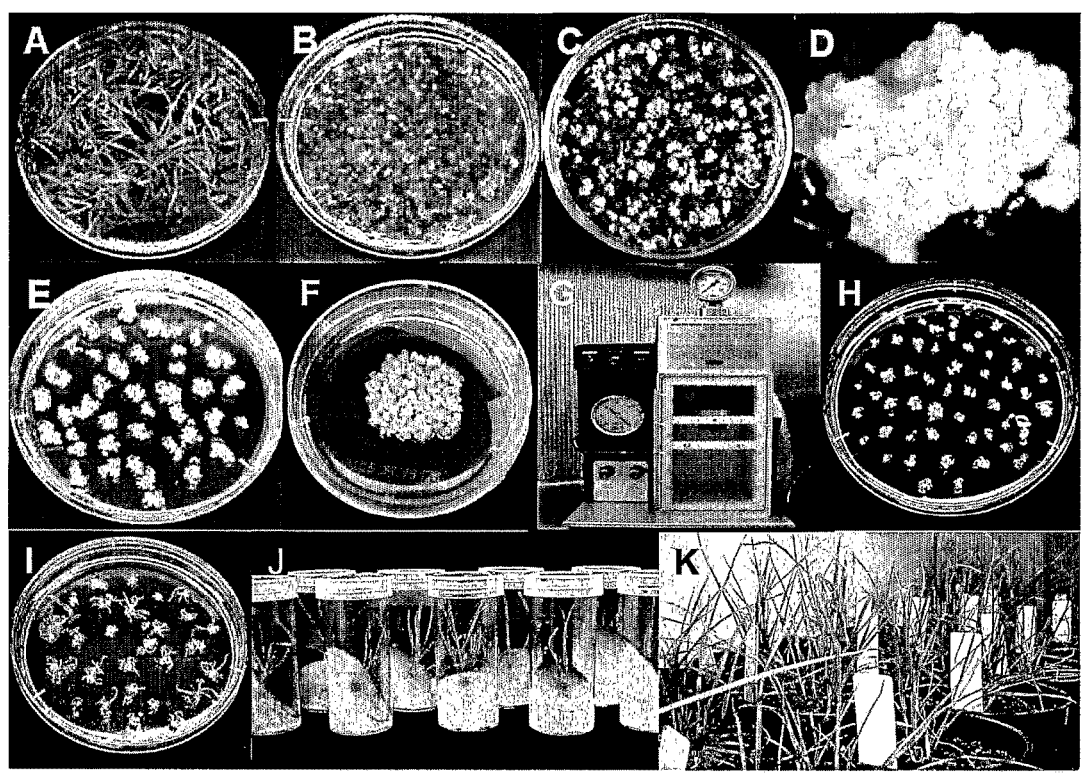

FIG. 51 A-K. Production of transgenic perennial ryegrass from microprojectile bombardment of embryogenic calli derived from seedling meristems. A) In vitro shoot culture for basal meristem isolation; regenerated from seedling meristem-derived calli; B) Distribution of basal meristematic material on callus initiation medium; C-E) Induction and proliferation of embryogenic calli from shoot meristems of *Lolium perenne*; F) Distribution of embryogenic calli on high osmotic medium prior to biolistic transformation; G) Biolistic transformation device, PDS-1000/He; H-I) Growth and development of hygromycin-resistant shoots, 30-84 days post bombardment; J) Growth and development of hygromycin-resistant shoots in vitro; K) Hygromycin-resistant plants established in soil and grown under containment glasshouse conditions.

Figure 52:
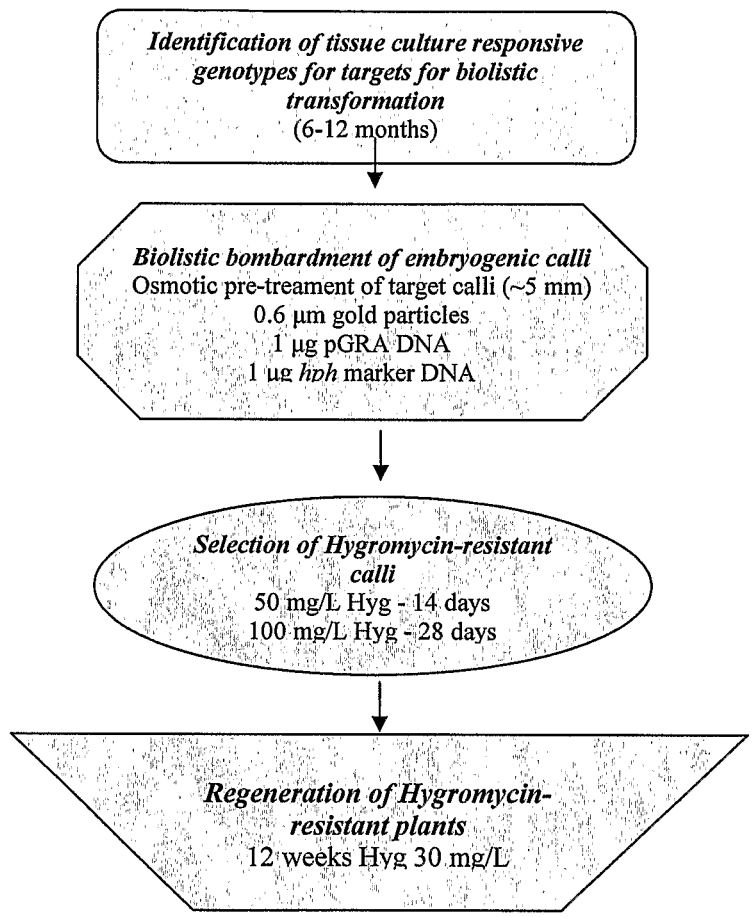

FIG. 52. Flowchart describing the transformation method used to generate transgenic perennial ryegrass containing the expression construct of interest and the selectable marker gene (hph).

Figure 53:
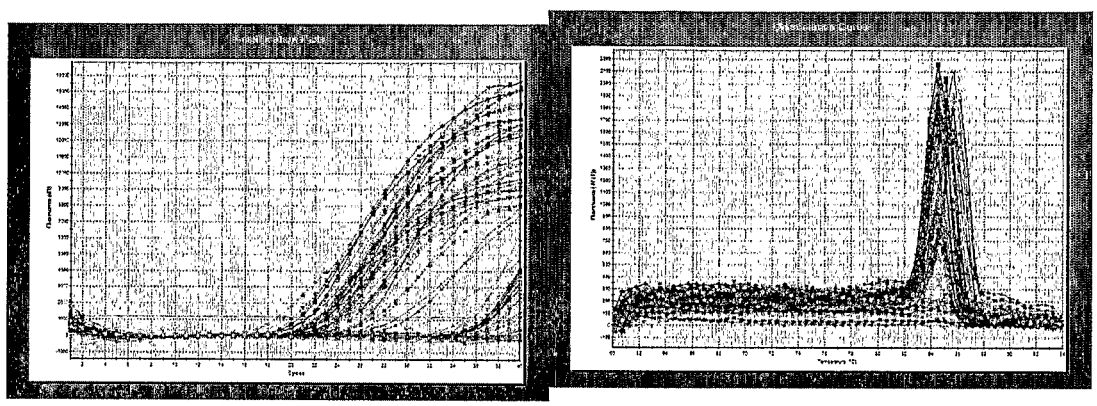

FIG. 53. Amplification of the hygromycin phosphotransferase (hph) gene by Q-PCR in samples of genomic DNA extracted from putative transgenic perennial ryegrass regenerated after co-bombardment with plasmids pAcH1 and pAUX3132-LpCAD2::LpCAD3::LpCAD2.

Figure 54:
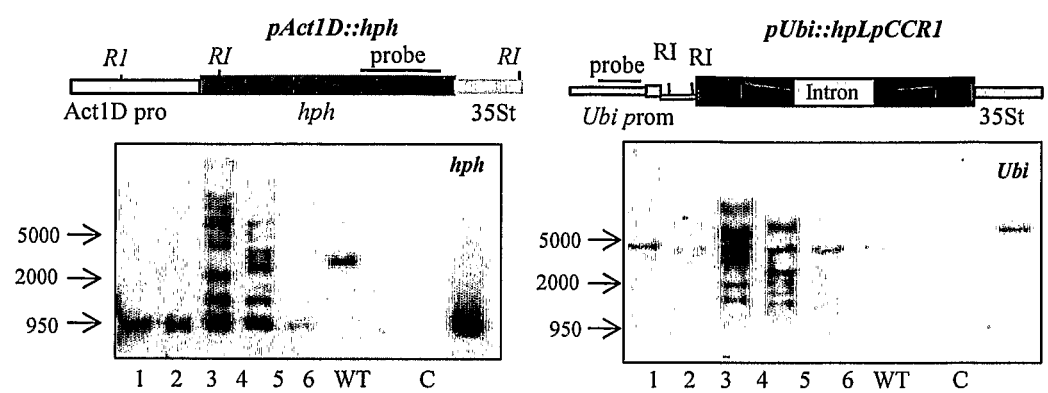

FIG. 54. Southern analysis of genomic DNA digested with Eco R1 (R1) and separated by agarose gel electrophoresis and the transgene detected with either hph or Ubi promoter probes. All six putative transgenic plants were confirmed to contain both hph and the gene-of-interest, hpLpCCR1.

Figure 55:
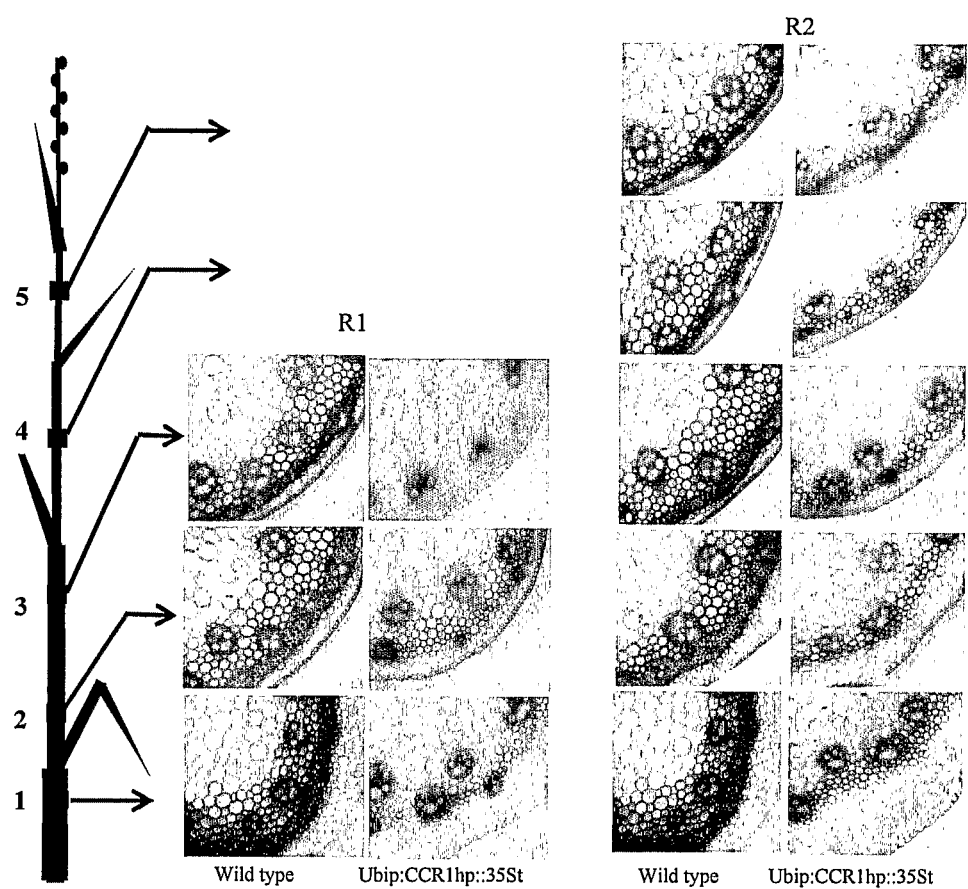

FIG. 55. Maule staining of cross-sectioned internodes from wild type and transgenic pUbi::hpCCR1::35S ryegrass at R1 and R2 stage shows a strong decrease of reddish colour in transgenic plants which may suggest a decrease in S lignin content compared to wild type plants.

Figure 56:
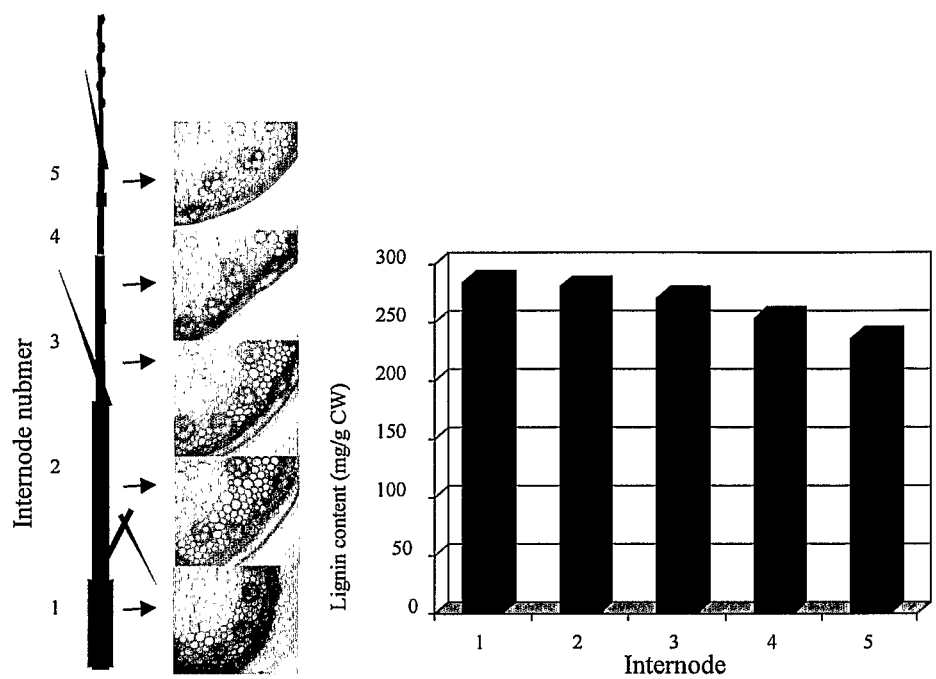

FIG. 56. Total lignin content of perennial ryegrass internodes at the R1 developmental stage shows a progressive reduction in lignin content from internode 1 (base) to internode 5 (top).

Figure 57:
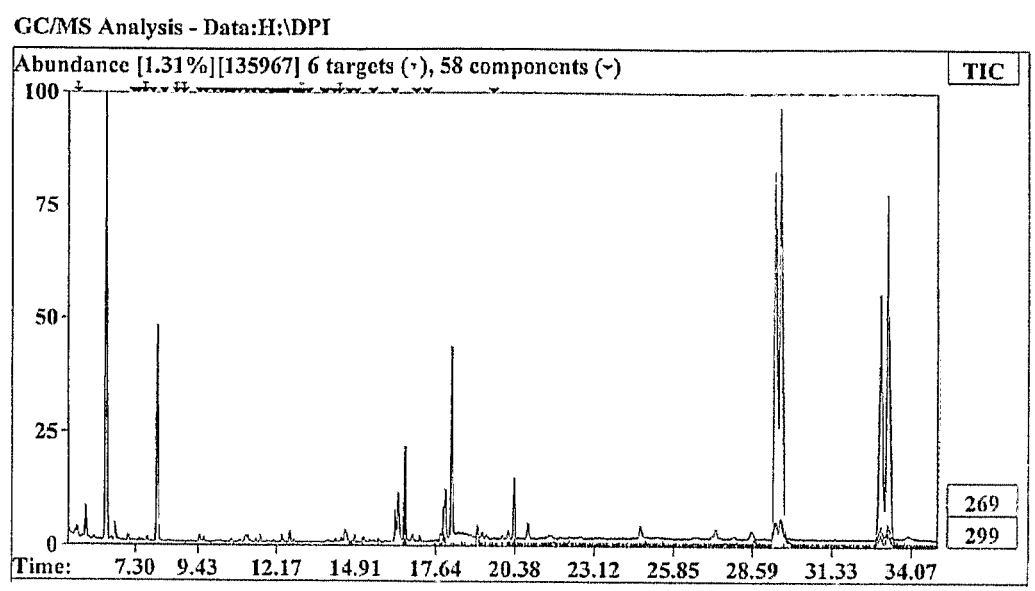

FIG. 57. Example of a gas chromatogram (GC-MS) showing separation and identification of G-lignin and S-lignin monomers after thioacidolysis derivatisation of lignin extracted from wild type perennial ryegrass.

EXAMPLE 1

Isolation and Characterisation of Three 4-Coumarate CoA-Ligase (4CL) cDNAs from *Lolium perenne*

Materials and Methods
Plant Material

Figure 1:
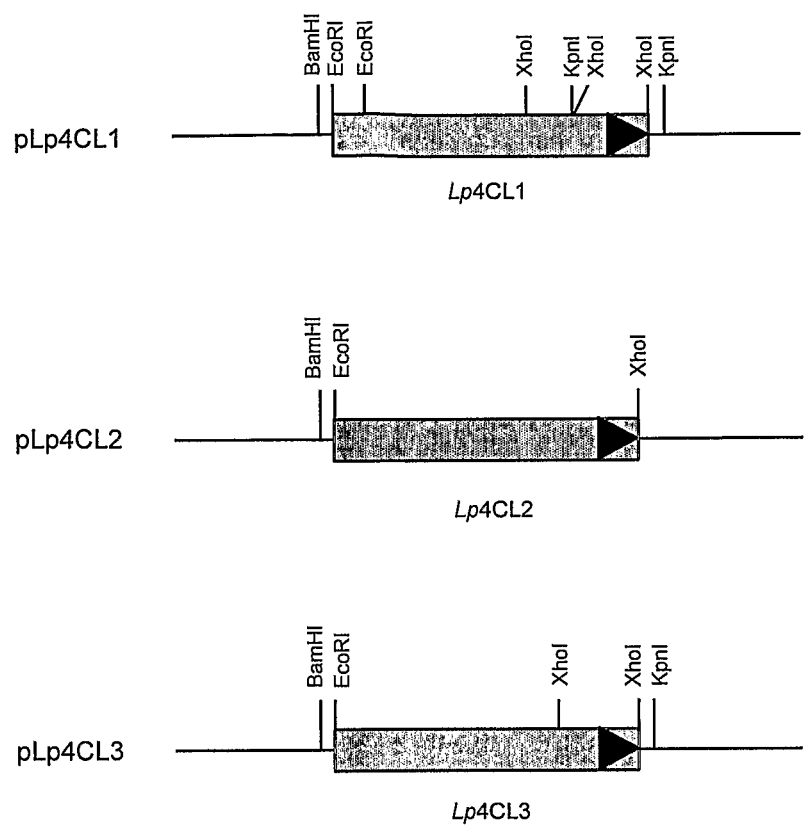
FIG. 1 shows plasmid maps of the three cDNAs encoding perennial ryegrass 4CL homologues.

Plants and embryogenic cell suspensions of perennial ryegrass (*Lolium perenne* L.) cv Ellet and tall fescue (*Festuca arundinacea* Schreb.) cv Triumph were established and maintained as previously described (Heath et al., 1998). Wounding experiments were performed with 10-day-old seedlings of perennial ryegrass (cv Ellet) as previously described (Heath et al., 1998).
Screening of a cDNA Library A cDNA library prepared with RNA isolated from perennial ryegrass seedlings (Heath et al., 1998) was screened with a [$^{32}$P]dCTP-labelled rice partial 4CL probe. The rice 4CL probe and consisted of a 844 bp 4CL specific sequence inserted into PUC119. This insert has 93% sequence identity with a rice 4CL cDNA sequence (Genbank, L43362, bases 453-1300). cDNA inserts were excised and recirculated using the ExAssist helper phage with SOLR strain (Stratagene) as described by the manufacturer.
DNA Sequencing cDNA clones were digested with 8 restriction enzymes (BamHI, EcoRI, KpnI, NotI, PstI, SalI, XbaI, XhoI) and selected clones were sequenced on both strands by the dideoxy chain termination method using M13 forward and reverse primers. For sequencing the internal regions of Lp4CL1, Lp4CL2 and Lp4CL3 synthetic oligonucleotide primers were designed from the DNA sequences previously determined. Sequencing was performed using the ABI dye terminator kit and automatic sequencer. Nucleotide sequences were aligned using the SeqEd program (ABI) and further analysis was performed using the HIBIO DNASIS vs2 program (Hitachi Software Engineering).
Genomic DNA Blot Analysis Genomic DNA was isolated from single genotype-derived cell suspensions of perennial ryegrass and tall fescue according to Lichtenstein and Draper (1985). Ten µg of perennial ryegrass DNA and 20 µg of tall fescue DNA was digested with each of the restriction enzymes HindIII and XbaI, separated on 1% agarose gels, and transferred to Hybond N+ membranes according to the manufacturer's instructions (Amersham). Probes consisted of BamHI/KpnI fragments of Lp4CL1 (1771 bp), Lp4CL2 (2034 bp) or Lp4CL3 (2080 bp) labelled using the Megaprime labelling kit (Amersham) and [$^{32}$P]dCTP. Hybridization was performed at 65 oc in 5×SSPE, 5×Denhardt's solution, 0.5% (w/v) SOS, and 200 µg/ml denatured herring sperm DNA. Membranes were washed three times in 2×SSPE, 0.1% SOS for 10 min at 25 oc and then twice in 0.1×SSPE, 0.1% SOS for 20 min at 65 oc.
RNA Blot Analysis Total RNA (10 µg) was separated on 1.2% formaldehyde gels and transferred to Hybond N (Amersham) membranes according to the manufacturers instructions. Membranes were stained with 0.2% methylene blue to confirm correct loading and transfer of RNA. Hybridisation was performed at 42 oc in 5×SSPE, 5×Denhart's solution, 0.5% SOS, 50% deionized formamide, 200 µg/mL denatured herring sperm DNA. Preparation of probes and washing of membranes was as for DNA blot analysis except for the tall fescue Northern blot when the final two washes were performed with 0.1× SSPE, 0.1% SOS for 10 min at 42° C.
Results
Isolation and Sequence Analysis of Perennial Ryegrass 4CL cDNAs A cDNA library prepared from RNA extracted from perennial ryegrass seedlings was screened with a rice 4CL hybridization probe and ten cDNAs were isolated from 2×10$^5$ pfu. The cDNAs were characterised by restriction analysis with 8 restriction enzymes. All clones were full length (approximately 2.0-2.2 kb) with poly(A) tails and could be separated into three groups: Lp4CL1 (four clones) Lp4CL2 (five clones) and Lp4CL3 (one clone). Plasmid maps for Lp4CL1, Lp4CL2 and Lp4CL3 are shown (FIG. 1). Lp4CL1, Lp4CL2 and Lp4CL3 were fully sequenced (FIGS. 2, 3 and 4, respectively).

Lp4CL1 is 2284 bp long with an open reading frame (ORF) of 1710 bp, a 5' noncoding region of 322 bp and a 3' noncoding region of 252 bp including a poly(A) tail. Lp4CL2 is 1992 bp long with an ORF of 1668 bp, a 5' noncoding region of 61 bp and a 3' noncoding region of 263 bp including a poly(A) tail. Lp4CL3 is 2038 bp long with an ORF of 1671 bp, a 5' noncoding region of 112 bp and a 3' noncoding region of 255 bp including a poly(A) tail.

Within the coding region, Lp4CL1 has 70% nucleic acid sequence identity with both Lp4CL2 and Lp4CL3, while Lp4CL2 has 79% sequence identity with Lp4CL3. There is little sequence homology in the 3' noncoding regions between clones (52-55%).

Amino Acid Sequence Comparisons

The putative proteins encoded by the three cDNAs consist of 570 amino acids [60290 u (Da)] for Lp4CL1, 556 amino acids (59238 u) for Lp4CL2 and 557 amino acids (59735 u) for Lp4CL3. The deduced amino acid sequences of Lp4CL1, Lp4CL2 and Lp4CL3 are shown (FIG. 5). Lp4CL2 and Lp4CL3 share 79% amino acid sequence identity, Lp4CL1 and Lp4CL2 have 61% amino acid sequence identity, while Lp4CL1 and Lp4CL3 have only 58% amino acid sequence identity. Regions of high sequence homology are more prevalent in the central and c-terminal regions of the enzyme. For example the sequence identity between amino acids 208 to 568 of each enzyme is 85% for Lp4CL2 and Lp4CL3, 72% for Lp4CL1 and Lp4CL2 and 67% for Lp4CL1 and Lp4CL3.

Lp4CL1, Lp4CL2 and Lp4CL3 share several common regions with other plant 4Cls. In particular, they contain the putative AMP-binding domain and the conserved GEICIRG motif, except for Lp4CL3 where the second isoleucine has been replaced with valine (FIG. 5). It has been proposed that domain II is associated with the catalytic activity of 4CL. Also, four Cys residues conserved in plant 4Cls are conserved in Lp4CL1, Lp4CL2 and Lp4CL3 (FIG. 5). These results suggest that the *L perenne* cDNAs encode three divergent 4CL enzymes that are likely to have originated from three different 4CL genes.

Expression of Perennial Ryegrass 4CL Genes

Lp4CL1, Lp4CL2 and Lp4CL3 were used as hybridization probes in Northern blots with RNA prepared from different organs of perennial ryegrass at two developmental stages. All three probes hybridized to a single mRNA species of approximately 2.2-2.3 kb. Lp4CL1, Lp4CL2 and Lp4CL3 were expressed at both seedling and mature stages of development and in all organs tested. For Lp4CL2 and Lp4CL3 the strongest signal was found in RNA samples from seedling roots and mature stems (FIG. 6).

Lp4CL1, Lp4CL2 and Lp4CL3 were also used as hybridization probes in Northern blots with RNA prepared from tall fescue. All three probes hybridized to a similar mRNA species (2.3 kb) as that in perennial ryegrass (FIG. 6). The strongest signal was found in RNA samples from mature stems with weaker signals in RNA from roots and seedling shoots. No expression of Lp4CL1, Lp4CL2 or Lp4CL3 was observed in leaves. The three probes varied in their ability to hybridize to the corresponding homologues in tall fescue, with Lp4CL3 resulting in the highest signal and Lp4CL1 hybridizing only weakly.

To determine whether 4CL could be induced under stress conditions, leaves of perennial ryegrass seedlings were wounded. No increase in the transcript level upon wounding was observed with Lp4CL1, Lp4CL2 or Lp4CL3 (FIG. 7).

Genomic Organization of Perennial Ryegrass 4CL Genes

Perennial ryegrass DNA was digested with two restriction enzymes, HindIII or XbaI. Restriction sites for these enzymes are not present in the cDNA sequence of Lp4CL1, Lp4CL2 or Lp4CL3. When Lp4CL1, Lp4CL2 or Lp4CL3 was used as a probe, several DNA hybridizing fragments of varying intensity were revealed (FIG. 8). Each probe hybridized to a unique set of fragments, suggesting that Lp4CL1, Lp4CL2 and Lp4CL3 represent three different genes. Furthermore, Lp4CL1 and Lp4CL2 hybridized to 2 to 3 major fragments per digest which may represent either alleles of the same gene or indicate the presence of more than one gene in each class. The Lp4CL1, Lp4CL2 and Lp4CL3 probes also revealed several different size hybridizing DNA fragments in genomic Southern blots from tall fescue under high stringency conditions (FIG. 8), suggesting that three similar 4CL genes are present in *F. arundinacea*.

EXAMPLE 2

Isolation and Characterisation of a Cinnamoyl CoA Reductase (CCR) cDNA from *Lolium perenne*

A total of 500,000 phage were screened from a cDNA library constructed from ten-day-old etiolated *L. perenne* seedlings using a maize CCR probe. Ninety-three positive plaques were observed in the primary screen and five were subsequently analysed by restriction enzyme digestion. Four out of the five were identical. One of the four identical cDNAs, LpCCR1, was selected for further analysis (FIG. 9).

Nucleic Acid Sequence Analysis of Perennial Ryegrass CCR cDNA

The full nucleotide sequence of LpCCR1 was obtained and the amino acid sequence predicted (FIG. 10). LpCCR1 is a 1395 bp cDNA with 149 bp of 5' non-coding region and 160 bp of 3' non-coding region. An open reading frame of 1086 bp encodes a protein of 362 amino acids. The composition of the coding region was found to be 68% G+C rich. Codon usage was also examined and found to be biased towards XXC/G codons (94%), with XCG and XUA codons accounting for only 9% and 0.55% respectively. G+C richness and bias towards G and C in the third position of a codon triplet are previously reported characteristics of monocot genes.

Genomic Organization of Perennial Ryegrass CCR Gene

The number of CCR genes present in the ryegrass genome was determined by Southern blot analysis of genomic DNA from double haploid plants, using as probe a fragment of the LpCCR1 cDNA (LpCCR531, FIG. 9). Double haploid DNA reduces the complexity associated with allelic variation. Genomic DNA was cut with enzymes that do not cut the cDNA internally; Oral, BamHI, EcoRI, EcoRV, HindIII and XbaI, and the membrane was hybridised and washed under medium-stringency conditions. A single strongly hybridising band was evident in each lane (FIG. 11) indicating that there is a single copy of the LpCCR1 gene in the perennial ryegrass genome.

Expression of Perennial Ryegrass CCR Gene

To investigate the expression profile of the CCR gene in ryegrass, northern hybridisation analysis was carried out with total RNA extracted from roots and shoots at seedling growth stages (0.5-1 cm and 4-6 cm shoots) and roots, stem and leaves at mature growth stages (6 and 10 weeks). Seedlings were grown on filter paper in the dark at 25° C. and then transferred to soil and glasshouse conditions (25° C.) until the 6 and 10-week stages. Whole seedling total RNA from *Festuca* and *Phalaris* was included in the northern analysis. Hybridisation with LpCCR531 (FIG. 9) was performed at medium-stringency and the membrane was then washed at high-stringency. A transcript of approximately 1.5 kb was detected in all tissues, the level of expression varying with maturity and from one tissue type to another (FIG. 12). The LpCCR 1 transcript appears to be more abundant in roots and stem than shoots and leaves. In the stem, transcript abundance increases from 6-weeks to 10-weeks; indicating that transcription in stem tissue is up-regulated as the plant matures. Expression was found predominantly in tissues such as stems and roots that are forming secondary cell walls indicating that LpCCR1 is constitutively involved in lignification.

EXAMPLE 3

Isolation and Characterisation of Cinnamyl Alcohol Dehydrogenase (CAD) cDNAs from *Lolium perenne*

A 558 bp cinnamyl alcohol dehydrogenase (CAD) fragment was amplified from cDNA synthesised from total RNA prepared from perennial ryegrass seedlings. The conserved amino acid domains between *Pinus radiata, Medicago sativa, Aralia cordata, Eucalyptus botryoides* and *Arabidopsis thaliana* CADs were used to design oligonucleotides for the amplification of the perennial ryegrass CAD. The forward oligonucleotide was designed to the conserved amino acid domain CAGVTVYS and the reverse oligonucleotide to the conserved domain DVRYRFV. The 551 bp PCR fragment was cloned and sequenced to confirm that it corresponded to a perennial ryegrass CAD PCR fragment. A cDNA library prepared from RNA extracted from perennial ryegrass seedlings was screened with the 551 bp PCR fragment specific for perennial ryegrass CAD. Eight cDNAs were isolated and separated into six groups by restriction digest analysis. One representative clone each from two groups (LpCAD1, LpCAD2) were selected for further characterisation.

Nucleic Acid Sequence Analysis of Perennial Ryegrass CAD cDNAs

The complete sequence of the perennial ryegrass CAD homologue LpCAD1 was determined (FIG. 13). The 1325 bp clone had a poly (A) tail, typical start and stop codons and the open reading frame (ORF) of this clone coded for a putative protein of 408 amino acids.

The complete nucleotide sequence of the perennial ryegrass CAD homologue LpCAD2 was also determined (FIG. 14).

Expression of Perennial Ryegrass CAD Genes

A northern hybridisation analysis with RNA samples isolated from perennial ryegrass at different developmental stages hybridised with the full length LpCAD1 1325 bp cDNA (FIG. 15) was performed to determine patterns of organ and developmental expression. The probe hybridised to a single mRNA species of approximately 1.6 kb. The LpCAD1 transcript was expressed in all tissue tested: roots, shoots, stem and leaves (FIG. 16A). The LpCAD1 transcript was most abundant in root tissue and the mature stem, this expression pattern is typical of a gene involved in the lignification of plant cell walls. Intergeneric homologies were revealed in *Festuca* and *Phalaris*.

A similar northern hybridisation analysis was performed with LpCAD2 (FIG. 16B), however the transcript was found to be most abundant in mature stem tissue and the shoots.

Genomic Organization of Perennial Ryegrass CAD Genes

A Southern hybridisation analysis using DNA samples isolated from a perennial ryegrass double haploid plant digested with Oral, BamHI, EcoRI, EcoRV, HindIII and XbaI and hybridised with a 500 bp LpCAD1 probe was performed. The hybridisation pattern at high stringency revealed the presence of two prominent bands for most digests indicating that LpCAD1 belongs to a small gene family and exists a muliticopy gene in perennial ryegrass (FIG. 17A).

A similar Southern hybridization analysis was performed with LpCAD2 (FIG. 17B) the hybridisation pattern at high stringency revealed the presence of one or two prominent bands for most digests indicating that LpCAD2 exists as a single copy gene or a member of a small gene family in perennial ryegrass (FIG. 17B).

EXAMPLE 4

Isolation and Characterisation of Genomic Clones and Promoters for O-Methyltransferase (OMT), Cinnamoyl-CoA Reductase (CCR), 4 Coumarate CoA-Ligase (4CL) and Cinnamyl Alcohol Dehydrogenase (CAD) from *Lolium perenne*

Genomic clones and promoters of 0-methyltransferase (OMT), cinnamoyl-CoA reductase (CCR), 4 coumarate CoA-ligase (4CL) and cinnamyl alcohol dehydrogenase (CAD) were isolated from a perennial ryegrass genomic library using the corresponding cDNAs as hybridisation probes.

Isolation and Characterisation of Genomic Clones and Promoters for Perennial Ryegrass 0-Methyltransferase (OMT)

A perennial ryegrass genomic library was screened with the cDNA clone, Lp0mt1, (Heath et al. 1998) encoding 0-methyltransferase (OMT). The sequence of the 5' untranslated region and the coding region was found to be identical to that of the Lp0mt1 cDNA previously isolated. The entire 4.8 kb genomic clone was fully sequenced (FIG. 18).

To further characterise the promoters, transcriptional fusions of the promoter sequence to the p-glucuronidase (GUS) coding sequence (gusA) have been generated (FIG. 19). Direct gene transfer experiments to tobacco protoplasts were performed with the corresponding chimeric genes to transgenically express them in a heterologous system for in planta expression pattern analysis by histochemical GUS assays. A set of transgenic tobacco plants carrying a chimeric gusA gene under the control of the 5' regulatory region of the Lp0mt1 promoter was generated to assess the potential use of the Lp0mt1 promoter for xylem-specificity and targeted downregulation of genes encoding key lignin biosynthetic enzymes.

The transgenic tobacco plants generated using the Lp0mt1 promoter driven chimeric gusA transformation vector were screened by PCR and histochemical GUS assays.

A PCR screening was undertaken using gusA specific primers for the initial identification of transgenic tobacco plants (FIG. 20). PCR positive tobacco plants were screened by histochemical GUS assays for in p/anta expression pattern analysis (FIG. 20).

Isolation and Characterisation of Genomic Clones and Promoters for Perennial Ryegrass Cinnamoyl-CoA Reductase (CCR)

A CCR genomic clone from perennial ryegrass was isolated containing 6.5 kb of promoter and the entire gene organisation (intron/exon boundaries). The CCR promoter can be used for targeted expression of foreign genes in transgenic plants.

A perennial ryegrass genomic library was screened with the cDNA clone LpCCR1 which codes for the lignin biosynthetic enzyme, cinnamyl-CoA reductase (CCR). Four different genomic clones were identified based on restriction digest analysis. Clone 6.1.1a was selected for further analysis. A 6.42 kb XhoI fragment from clone 6.1.1a, which hybridized strongly to the LpCCR1 cDNA probe, was subcloned into pBluescriptSK (FIG. 21A). Sequence analysis revealed that the 6.42 kb XhoI fragment contained the entire LpCCR1 gene and 200 bp of promoter region. The intron/exon boundaries are illustrated in FIG. 21B, the location and the size of the exons appear to be conserved in other CCRs from different species (FIG. 21O).

To isolate the promoter region of LpCCR1, the Southern blot containing digested phage genomic DNA isolated from clone 11,Lp6.1.1a was reprobed with the 200 bp promoter region. The probe hybridized strongly to a 6.5 kb SafI fragment. This genomic fragment LpCCR1 clone 2, was subcloned into pBluescriptSK and sequenced (FIG. 22A). Sequence results revealed that the 6.5 kb SalI fragment contained 6.5 kb of promoter (FIG. 22B). The full sequence of LpCCR1 genomic clone containing the promoter and entire gene sequence (exons and introns) was obtained and is shown on FIG. 39.

Isolation and Characterisation of Genomic Clones and Promoters for Perennial Ryegrass 4 Coumarate CoA-Ligase (4CL)

A 4CL2 genomic clone from perennial ryegrass was isolated containing 2.5 kb of promoter and partial gene organisation (intron/exon boundaries). The 4CL2 promoter can be used for targeted expression of foreign genes in transgenic plants. The 2.5 kb promoter has been fused to the reporter gene gusA for expression analysis.

Figure 23A:
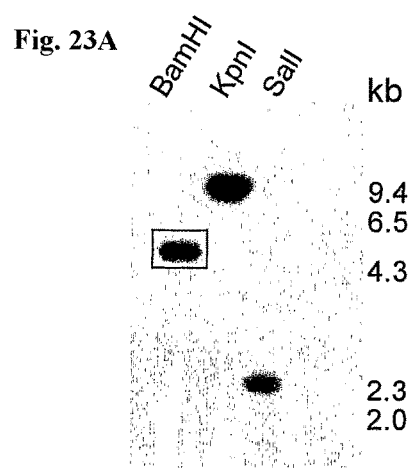

A perennial ryegrass genomic library was screened with an Lp4CL cDNA probe. After tertiary screening positive 4CL genomic clones were obtained and characterised by restriction digest and Southern hybridisation analysis (FIG. 23A).

Figure 23B:
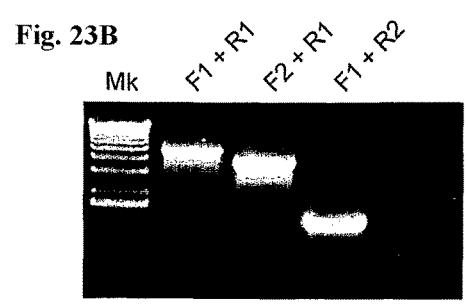
Figure 23C:
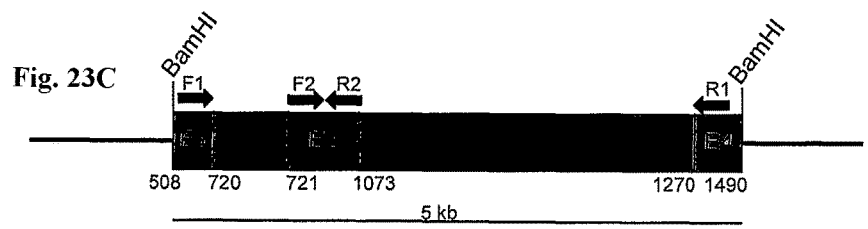

Sequence analysis revealed that the isolated 4CL genomic clone (4CL2) from perennial ryegrass had 100% nucleotide identity to the Lp4CL2 cDNA clone. To further characterise this 5 kb 11,Lp4CL2 genomic clone and to confirm that it corresponds to the cDNA of Lp4CL2, a number of PCR reactions using primers designed to the cDNA were used. PCR results confirmed that the 5 kb genomic fragment was a partial genomic clone corresponding to the Lp4CL2 cDNA (FIG. 23B). Using primer combinations F1 and R1 the entire 4.8kb genomic fragment was amplified. To determine the location of introns additional PCR reactions using the primer combinations F1/R2 and F2/R1 were performed, a 1 kb and 3.5 kb bands were amplified respectively. The location and size of the introns could be determined from these results, and further confirmed by sequence analysis. This large 5 kb genomic fragment contains 4 small exons representing the coding sequence of Lp4CL2 between 508 bp and 1490 bp (FIG. 23C).

Figure 24A:
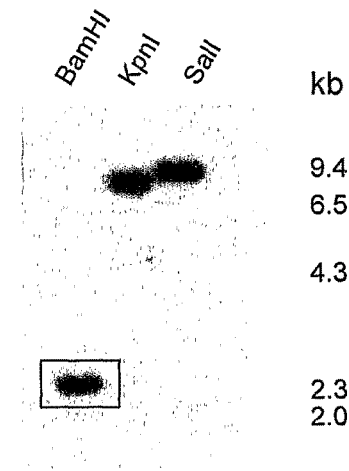
Figure 24B:
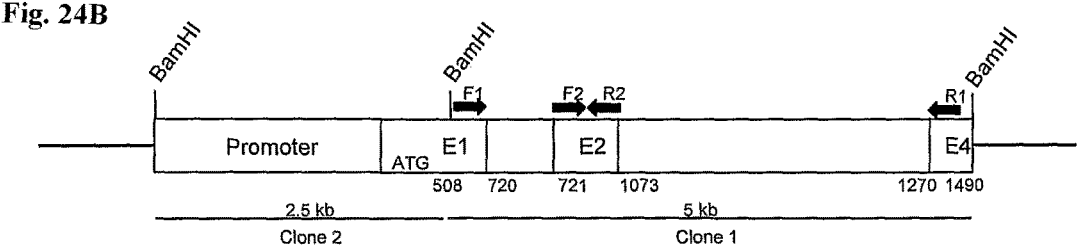

The genomic clone 1, Lp4CL2 contained no promoter region. To isolate the promoter region of Lp4CL2, the Southern blot containing digested phage genomic DNA isolated from clone 11,Lp4CL2 was reprobed with a 300 bp EcoRI/8gII isolated from the 5' end of the cDNA clone Lp4CL2. The 300 bp probe hybridised strongly to a 2.5 kb 8amHI fragment. This genomic fragment Lp4CL2 clone 2, was subcloned into p81uescriptSK and sequenced (FIG. 24A). Sequence results revealed that the 2.5 kb BamHI fragment contained the 508 bp of the 5' ORF of Lp4CL2 missing from genomic clone 1 and 2.0 kb of promoter region (FIG. 24B). The full sequence of the Lp4CL2 genomic clone containing the promoter and partial gene sequence (exons and introns) was obtained and is shown on FIG. 39.

The promoter from Lp4CL2 was thus isolated and used for the production of a chimeric gusA reporter gene (FIG. 25).

Isolation and Characterisation of Genomic Clones and Promoters for Perennial Ryegrass Cinnamyl Alcohol Dehydrogenase (CAD)

A CAD genomic clone from perennial ryegrass was isolated containing the gene organisation (intron/exon boundaries) minus intron 1 containing the first 111 bp of the CAD coding region. The genomic clone has allowed the identification of a G at position 851 bp in the coding region of the CAD2 genomic clone isolated from perennial ryegrass cv. Barlano which is absent in the CAD2 cDNA clone isolated from perennial ryegrass cv. Ellett. The SNP (single nucleotide polymorphism) found to exist between the 2 cultivars has the potential utility as a molecular marker for herbage quality, dry matter digestibility, mechanical stress tolerance, disease resistance, insect pest resistance, plant stature and leaf and stem colour.

Results below show the isolation of the genomic clone and sequence analysis of deduced coding sequence from the genomic clone CAD2 from perennial ryegrass cv. Barlano compared to the truncated cDNA CAD2 from the cv Ellett. The missing G in the perennial ryegrass cv. Ellett has been highlighted (FIGS. 26 and 27).

Figure 28A:
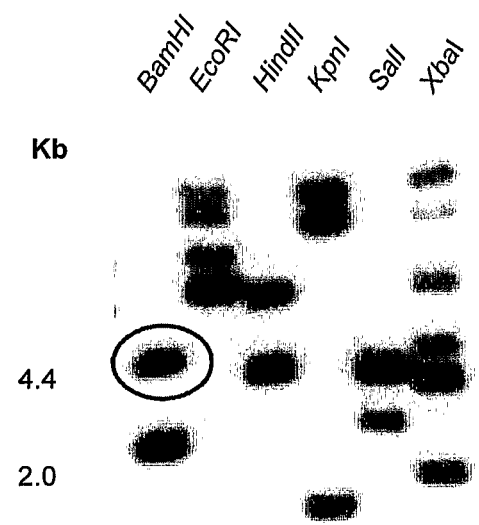
Figure 28B:
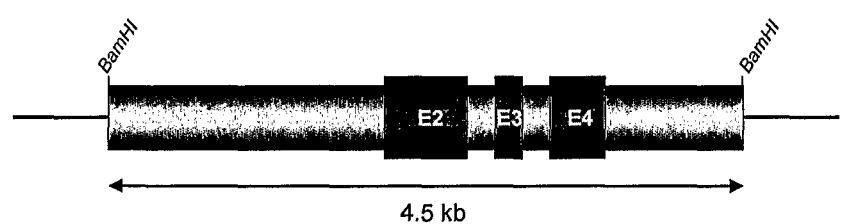

A perennial ryegrass genomic library was screened with a probe corresponding to the 5' end of the LpCAD2 cDNA clone, which codes for the lignin biosynthetic enzyme cinnamyl alcohol dehydrogenase. Ten positive plaques were identified and isolated in the primary library screening. After a secondary and tertiary screening, two positive plaques were obtained and corresponding positive genomic clones were further characterised by restriction digest and Southern hybridization analyses. Both genomic clones were found to be identical based on restriction digest analyses. One clone, named "A,LpCAD2 was chosen for further Southern hybridization analyses. A 4.5 kb BamHI fragment which hybridized strongly to the LpCAD2 cDNA probe was subcloned into pBluescriptSK and sequenced (FIG. 28A). Sequence analysis revealed that the 4.5 kb BamHI fragment was a partial genomic clone of LpCAD2. This large 4.5 kb genomic fragment contains 4 small exons representing the coding sequence of LpCAD2 between 213 bp and the stop codon at 1213 bp, and the location of the intron/exon boundaries are illustrated in FIG. 28B.

EXAMPLE 5

Development of Transformation Vectors Containing Chimeric Genes with 4CL, CCR and CAD cDNA Sequences from Perennial Ryegrass To alter the expression of the key enzymes involved in lignin biosynthesis 4CL, CCR and CAD, through antisense and/or sense suppression technology and for over-expression of these key enzymes in transgenic plants, a set of sense and antisense transformation vectors was produced. Transformation vectors containing chimeric genes using perennial ryegrass 4CL, CCR and CAD cDNAs in sense and antisense orientations under the control of either the CaMV 35S or the maize ubiquitin promoter were generated (FIGS. 29, 30 and 31).

EXAMPLE 6

Production and Characterisation of Transgenic Tobacco Plants Expressing Chimeric 4CL, CCR and CAD Genes from Perennial Ryegrass A set of transgenic tobacco plants carrying chimeric 4CL, CCR and CAD genes from perennial ryegrass were produced and analysed.

Transformation vectors with Lp4CL1, Lp4CL2 and Lp4CL3 full length cDNA sequences in sense and antisense orientations under the control of either the CaMV 35S or the maize ubiquitin promoters were generated. Transformation vectors with LpCCR1 cDNA in both sense and antisense orientation under the control of either the CaMV 35S and maize ubiquitin promoters were generated. Transformation vectors with 1325 bp full length LpCAD1 cDNA in sense and 1051 bp partial LpCAD1 cDNA in antisense orientation under the control of either the CaMV 35S and maize ubiquitin promoters were generated.

Direct gene transfer experiments to tobacco protoplasts were performed using these transformation vectors.

The production and molecular analysis of transgenic tobacco plants carrying the perennial ryegrass Lp4CL1 and LpCCR 1 cDNAs under the control of the constitutive CaMV 35S promoter is described here in detail.

A set of transgenic tobacco plants generated using the Lp4CL1 sense transformation vector was screened by PCR and subjected to Southern and northern hybridization analyses.

A PCR screening was undertaken using npt2 and Lp4CL1 specific primers for the initial identification of transgenic tobacco plants. Independent transgenic tobacco plants were identified to be co-transformed with both the selectable marker npt2 and the Lp4CL1 chimeric genes (FIG. 32).

Southern hybridisation analysis was performed with DNA samples from PCR positive transgenic tobacco plants to demonstrate the integration of the chimeric Lp4CL1 transgene in the tobacco plant genome. Independent transgenic tobacco plants carried between 1 and 5 copies of the Lp4CL1 transgene. No cross-hybridization was observed between the endogenous tobacco 4CL gene and the perennial ryegrass hybridization probe used (FIG. 32).

Northern hybridization analysis using total RNA samples prepared from the transgenic tobacco plants carrying the chimeric sense Lp4CL1 transgene and probed with the Lp4CL1-specific hybridization probe revealed the presence of a 1.2 kb Lp4CL1 transcript strongly expressed in one Lp4CL1-transgenic tobacco plant analysed (FIG. 32).

The sense and antisense transformation vectors of LpCCR1 under the control of the CaMV 35S promoter were introduced into tobacco protoplasts via direct gene transfer. A set of transgenic tobacco plants was generated and screened by PCR with specific primers to identify transgenic tobacco plants carrying chimeric LpCCR1 transgene. The molecular analysis of LpCCR1-transgenic tobacco plants is shown (FIG. 33).

EXAMPLE 7

Production and Characterisation of Transgenic Perennial Ryegrass Plants Expressing Chimeric OMT, 4CL, CCR and CAD Genes from Perennial Ryegrass An improved transformation method was developed for the production of transgenic perennial ryegrass plants by biolistic transformation of embryogenic cells. Transgenic perennial ryegrass plants were generated using chimeric OMT, 4CL, CCR and CAD genes from perennial ryegrass and the improved transformation method.

Improved Method for the Production of Transgenic Perennial Ryegrass Plants

This improved procedure utilises embryogenic calli produced from mature seed-derived embryos as direct targets for biolistic transformation without requiring the establishment of embryogenic cell suspensions. The protocol relies on a continuous supply of isolated zygotic embryos for callus induction. Transgenic ryegrass plants can be regenerated 24-28 weeks after embryo isolation (FIG. 34). Isolated embryos are plated onto MSM5 medium to produce embryogenic calli suitable as targets for biolistic transformation within 8 weeks. The embryogenic calli, treated on high-osmoticum medium MSM3 Plus prior to microprojectile bombardment, are selected on MSM3 medium containing 100 mg/l paromomycin (Pm) for 2 weeks before being transferred onto MSK with 100 mg/l Pm for further 4 weeks until differentiation of Pm resistant shoot appear. Regenerated shoots are transferred on to fresh selective media MSK with 100 mg/l Pm for a further 4 weeks (FIG. 34).

Production of Transgenic Perennial Ryegrass Plants Expressing Chimeric OMT, 4CL, CCR and CAD Genes from Perennial Ryegrass Transgenic perennial ryegrass (*Lolium perenne*) plants were generated using chimeric ryegrass OMT, 4CL, CCR and CAD genes by biolistic transformation of embryogenic calli. Examples of the production and detailed molecular analysis of these transgenic ryegrass plants are described.

Transgenic perennial ryegrass plants for OMT down-regulation were produced using biolistic transformation of embryogenic calli and plant transformation vectors pUbiomt1 and pUbitmo1 carrying Lp0mt1 cDNA sequence in sense and antisense orientation under control of the constitutive maize ubiquitin promoter. These transgenic perennial ryegrass plants for down-regulated OMT activity were regenerated from paromomycin resistant calli obtained from biolistic transformation using microprojectilies coated with two plasmids; pHP23 (carrying the chimeric npt2 gene as the selectable marker) and either the sense or antisense Lp0mt1 transformation vector driven by the maize Ubi promoter.

Transgenic perennial ryegrass plants were subjected to a polymerase chain reaction (PCR) screening using npt2-specific primers. Independent npt2 PCR-positive transgenic perennial ryegrass plants obtained from biolistic transformation of embryogenic calli—generated from approximately 60,000 isolated mature seed-derived embryos—using Lp0mt1 sense (pUbiomt1) and Lp0mt1 antisense (pUbitmo1) transformation vectors were identified [16 pUbiomt1 transgenic plants and 27 pUbitmo1 transgenic plants] (FIG. 35).

Southern hybridization analysis was performed with undigested and HindIII-digested DNA samples prepared from the PCR positive transgenic perennial ryegrass plants, to demonstrate their transgenic nature and the integration of the chimeric npt2 and Lp0mt1 transgenes. Independent transgenic perennial ryegrass plants co-transformed with both, the selectable marker npt2 gene and Lp0mt1 chimeric genes, were identified (FIG. 35). In most instances, the transgenic perennial ryegrass plants recovered contained multiple copies of the selectable marker gene including rearranged transgene copies. No npt2-hybridizing bands were detected in the untransformed negative control.

Samples of HindIII-digested genomic DNA were included in the analysis when the Lp0mt1 gene-specific hybridization probe (omt1) was used. The omt1 probe hybridized to a number of bands in DNA samples corresponding to both, the transgenic plants and the untransformed negative control. The omt1-hybridizing bands shared in all samples correspond to endogenous Lp0mt1 gene sequences represented as a small multigene family in the perennial ryegrass genome (Heath et al. 1998). The different omt1-hybridizing bands evident in the samples from the transgenic plants and absent in the untransformed negative control sample correspond to antisense (tmo1) and sense (omt1) Lp0mt1 transgene integration events (FIG. 35).

Northern hybridization analysis using strand-specific Lp0mt1 probes allowed the identification of transgenic perennial ryegrass plants expressing the antisense Lp0mt1 transgene (FIG. 35).

The OMT activity of selected antisense and sense Lp0mt1 transgenic perennial ryegrass plants was determined. Biochemical assays for OMT activity were initially established in untransformed plants (such as tobacco and perennial ryegrass). The assays utilise radiolabelled S-adenosylmethionine as the methyl donor for the OMT-catalysed conversion of caffeic acid into ferulic acid. The production of radioactive ferulic acid is measured and allows the OMT activity to be determined.

The OMT activity of selected Lp0mt1-transgenic perennial ryegrass plants (*L. perenne* cv. Ellett) was determined. Significantly altered OMT activity in individual transformation events was observed (FIG. 36). The manipulation of OMT activity in transgenic perennial ryegrass plants due to the expression of the chimeric ryegrass Lp0mt1 gene was thus demonstrated.

Transgenicperennial ryegrass plants were recovered, using biolistic transformation of embryogenic calli, for the manipulation of the expression of genes encoding the key lignin biosynthetic enzyme, 4CL. The plant transformation vectors pUbi4CL2 and pUbi2LC4 carrying chimeric Lp4CL2 cDNA sequences in sense and antisense orientation, respectively, driven by the constitutive maize ubiquitin (Ubt) promoter were used. Perennial ryegrass plants for 4CL manipulation were regenerated from Pm-resistant calli obtained from biolistic transformation of embryogenic calli using microprojectiles coated with the plasmids pHP23, carrying a chimeric npt2 gene as selectable marker gene and the antisense pUbi2LC4.

Transgenic perennial ryegrass plants were subjected to a polymerase chain reaction (PCR) screening using npt2-specific primers. Independent npt2 PCR-positive transgenic perennial ryegrass plants were obtained from biolistic transformation of embryogenic calli (FIG. 37).

Transgenic perennial ryegrass plants were also recovered, using biolistic transformation of embryogenic calli, for the manipulation of the expression of genes encoding the key lignin biosynthetic enzymes, CCR and CAD.

EXAMPLE 8

Genetic Mapping of Perennial Ryegrass OMT, 4CL, CCR and CAD Genes

Lp4CL1, Lp4CL3, LpCAD1, LpCAD2, LpCCR1, LpOMT1 and LpOMT2 clones were PCR amplified and radio-labelled for use as probes to detect restriction fragment length polymorphisms (RFLPs). RFLPs were mapped using 110 progeny individuals of the p150/112 perennial ryegrass reference population restricted with the enzymes described in Table 3 below.

TABLE 3

Mapping of RFLPs

| Clones | Polymorphic in p150/112 | Enzyme mapped with | Locus | Linkage group |
|---|---|---|---|---|
| Lp4CL1 | y | Oral | Lp4CL1 | 2 |
| Lp4CL3 | y | EcoRV | Lp4CL3 | 6 |

TABLE 3-continued

Mapping of RFLPs

| Clones | Polymorphic in p150/112 | Enzyme mapped with | Locus | Linkage group |
|---|---|---|---|---|
| LpCAD1 | y | EcoRV | LpCAD1 | 2 |
| LpCAD1.2.1 | y | EcoRI | LpCAD2a | 7 |
| | | | LpCAD2b | — |
| | | | LpCAD2c | 2 |
| LpCCR1 | y | EcoRI | LpCCR1 | 7 |
| LpOMT1 | y | Oral | LpOMT1 | 7 |
| LpOMT2 | y | EcoRV | LpOMT2 | 6 |

Lp4CL1, Lp4CL3, LpCAD1, LpCAD2, LpCCR1, LpOMT1 and LpOMT2 loci mapped to the linkage groups as indicated in Table 3 and in FIG. 40. These gene locations can now be used as candidate genes for quantitative trait loci for lignin biosynthesis associated traits such as herbage quality, dry matter digestibility, mechanical stress tolerance, disease resistance, insect pest resistance, plant stature and leaf and stem colour.

EXAMPLE 9

Sense Suppression

DNA Sequence Elements and Construct Production

Three constructs were engineered for development of transgenic perennial ryegrass with modified lignin biosynthesis, using sense suppression technology. The individual components of the sequence elements are listed in Table 4. The promoters and terminators used in construct production originated from perennial ryegrass genomic sequences. The genes were derived from perennial ryegrass cDNA sequences. The origin of the pAUX plasmid vectors has been described previously (Goderis et al., 2002).

TABLE 4

Components used in the generation of constructs for perennial ryegrass transformation.

| Construct No. | Vector backbone | Promoters | Genes | Terminators |
|---|---|---|---|---|
| 1 | pAUX3132 | LpCAD2 | LpCAD3 | LpCAD2 |
| 2 | pAUX3169 | LpCCR1 | LpCCR1 | LpCCR1 |
| 3 | pAUX3169 | LpCCR1 | LpCCR1(fs) | LpCCR1 |

The constructs were produced using Gateway™ technology (Invitrogen). The Gateway™ cloning system consists of one vector backbone and several auxiliary vectors based on pUC18 (Goderis et al., 2002). The multisite recombination cassette was assembled in the auxiliary vectors utilizing the multi-cloning site, flanked by homing endonuclease sites (FIG. 41). Homing endonucleases are rare cutting restriction enzymes minimising the risk of accidental restriction within the expression cassettes if excision of the expression cassette is required.

The respective promoter, cDNA and terminator sequences were amplified by PCR using primers incorporating the appropriate AttB recombination sequences and cloned into separate Gateway™ Entry vectors. For example, three Entry clones were required for the generation of the LpCAD expression vector (Construct 1); the LpCAD3 cDNA (FIG. 42), the LpCAD2 promoter (FIG. 43) and the LpCAD2 terminator (FIG. 44). These were then combined with pAUX3132 for the multi-recombination reaction and generation of the expression cassette pAUX3132-LpCAD2::LpCAD3::LpCAD2 (FIG. 45).

For Construct 2, Entry clones with the individual components; LpCCR1 promoter, LpCCR1 cDNA, and LpCCR1 terminator were generated using the same PCR cloning strategy. The Entry clones were combined in a recombination cloning reaction with base vector pAUX3169 to produce the final construct pAUX3169-LpCCR1::LpCCR1::LpCCR1 (FIG. 46).

For Construct 3, an alternative silencing strategy was employed involving a frame-shift based approach. This method involves the deletion of a single base pair, just downstream of the start site, which is introduced using a forward primer which has the single base deletion (FIG. 47). This construct works via sense suppression, as the transcript produced will not encode the correct protein and no functional protein will be produced.

The Entry clones with individual components LpCCR1 promoter, LpCCR1(fs) cDNA, and LpCCR1 terminator were generated and combined in a recombination cloning reaction with base vector pAUX3169 to produce the final construct pAUX3169-LpCCR1::LpCCR1(fs)::LpCCR1 (FIG. 48).

The plant selectable marker which facilitates selection of putative transgenic ryegrass on the antibiotic Hygromycin B is contained on a separate plasmid, pAcH1. This plasmid utilizes the rice Actin1D promoter to drive in planta expression of the hygromycin phosphotransferase (hph) gene. The pAcH1 plasmid has been used previously in the transformation of forage grasses (Spangenberg et al., 1995).

Transformation Protocols

The protocol developed and established is based on the biolistic transformation of embryogenic calli induced from immature inflorescences isolated from an in planta maintained vernalised collection of perennial ryegrass, or seedling meristems derived from in vitro seedling cultures. Illustrations of the different stages in both processes, from the isolation of explants for the induction and proliferation of embryogenic calli for genetic transformation to the recovery of transgenic plants are shown in FIGS. 50 and 51. Both genetic transformation methods allow for a sustainable, readily-available source of donor plant materials which are highly competent for plant regeneration and genetic transformation and are compatible with biolistic transformation techniques. A general outline of the process involved in transformation is described in FIG. 52.

Molecular Analysis of Putative Transgenic Plants

Molecular analysis of putative transgenic perennial ryegrass plants has been conducted using primers for Q-PCR. The following primers were designed:
1. Primers specific for the hph gene
2. Primers across the CAD2 promoter-CADS gene junction
3. Primers specific for the pAUX3169 vector (as primers specific for the CCR1 junctions could also amplify endogenous genomic sequences).

An example of Q-PCR run for detection of hph in extracted genomic DNA is shown in FIG. 53.

The results summarising the number of transgenic perennial ryegrass plants for each Construct is shown in Table 5.

TABLE 5

Summary of transformation progress for perennial ryegrass lines harbouring constructs for the modification of lignin biosynthesis.

| Construct | Vector | No. Putative Transgenics | No. hph positive | No. GOI positive |
|---|---|---|---|---|
| 1 | pAUX3132-LpCAD2::LpCAD3-LpCAD2 | 180 | 65 | 25 |
| 2 | pAUX3169-LpCCR1::LpCCR1::LpCCR1 | 90 | 67 | 38 |
| 3 | pAUX3169-LpCCR1::LpCCR1(fs)::LpCCR1 | 322 | 185 | 141 |
| Total | | 592 | 317 | 204 |

Down-Regulation of CAD and CCR Expression by RNA Interference and Sense Suppression In order to modify the expression level of LpCCR1 in perennial ryegrass, an RNA-mediated posttranscriptional gene silencing strategy was employed (RNA interference). The maize Ubiquitin (Ubi) promoter was used to drive expression of a LpCCR1 hairpin (hp) construct containing the variable region of 3' UTR in transgenic perennial ryegrass. Immature inflorescence-derived calli of perennial ryegrass were used as a target for biolistic transformation. hpLpCCR1 transgenic ryegrass plants were confirmed by Southern analysis (FIG. 54), In the same manner, CAD and CCR expression is modified in perennial ryegrass using constructs 1, 2 and 3 (sense suppression).

Analysis of Lignin in Transgenic Plants

Lignin content and composition is visualised by specialized staining methods, including Maule histochemical staining which can differentiate between G-lignin and S-lignin monomers (Moore et al., 1991). Maule staining of flowering stems from different internodes was conducted for wild type and Ubi::hpLpCCR1 transgenic perennial ryegrass. The results demonstrate that there is significantly less lignin accumulating in stems at both the early reproductive (R1) and mid-reproductive (R2) stages (FIG. 55). Furthermore, there is an acropetal (base to apex) decrease in the relative amount of total lignin in the different internodes.

In the same manner, lignin content and composition is analysed in transgenic perennial ryegrass lines harbouring constructs 1,2 and 3.

Additional lignin analytical methods includes isolation of cell wall material by successive hot water, ethanol and chloroform/methanol extractions (Fukushima and Hatfield, 2001) followed by determination of total lignin content/dry weight, using acetyl bromide method (Liyama and Wallis, 1990) (FIG. 56).

Further lignin monomer analysis to determine the G/S ratio is performed by thioacidoylysis cleavage method (Rolando et al., 1992) and quantification using a gas chromatography (GC-MS) (FIG. 57).

REFERENCES

Fukushima, R. S. and R. D. Hatfield (2001). "Extraction and isolation of lignin for utilization as a standard to determine lignin concentration using acetyl bromide spectrophotometric method." *J. Agri. Food Chem.* 49: 3133-3139.

Goderis, I., M. De Balle, I. Francois, P. Wouters, W. Broekaert and B. Cammue (2002). "A set of modular plant transformation vectors allowing flexible insertion of upto six expression units." *Plant Mol Biol* 50: 17-27.

Heath et al (1988) cDNA cloning and differential expression of three caffeic acid 0-methyltransferase homologues from perennial ryegrass (*Lolium perenne*). Journal of Plant Physiology 153:649-657

Lichtenstein, C, And J. Draper (1985) Genetic engineering of plants. In: D. M. Glover (ed.), DNA Cloning, Vol. 2, pp. 67-119, IRL Press, Washington.

Liyama, K. and A. F. A. Wallis (1990). "Determination of lignin in herbaceous plants by an improved acetyl bromide procedure." *J Sci Food Agric* 51: 145-161.

Moore, K. J., L. E. Moser, K. P. Vogel, S. S. Waller, Johnson 8. E. and P. J. F. (1991). "Describing and quantifying growth stages of perennial forage grasses." *Agron. J.* 83: 1073-1077.

Rolando, C., 8. Monties and C. Lapierre (1992). Thioacidolysis. *Methods in Lignin Chemistry* S. Y. Lin and C. W. Dence, Springer-Verlag: pp. 334-349.

Spangenberg, G., Z. Y. Wang, X. L. Wu, J. Nagel, V. A. Iglesias and I. Potrykus (1995). "Transgenic tall fescue and red fescue plants from microprojectile bombardment of embryogenic suspension cells." *J Plant Physiol* 145: 693-701.

Finally, it is to be understood that various alterations, modifications and/or additions may be made without departing from the spirit of the present invention as outlined herein.

It will also be understood that the term "comprises" (or its grammatical variants) as used in this specification is equivalent to the term "includes" and should not be taken as excluding the presence of other elements or features.

Documents cited in this specification are for reference purposes only and their inclusion is not an acknowledgement that they form part of the common general knowledge in the relevant art.

SEQUENCE LISTING (363 sequences)

SEQ ID NO: 1 - DNA, 2284 bp, Lolium perenne
cggcacgagtggactttccgacgccggagtcgccgatgatgaccgccttgaggaggtagtcgtagtcgtcctccgccctgtacgcgccgctgcccgccatttccttcctcgcctcgcgggtcctcctccccgacctgcgctaggctctggatctcgcggggtttgggcgcggcgtcctcgctgtgagctcgtgccgaattcggcacgagccaccttcgaggcgtgcactggtacgagctcgcgagccattgtcagtgcagtgtaggctctgctactcgttggccattccaagaagctctctgctccctgaaaccagaggatcatgatcacggtggcggcgcccgaggtgcagcagccgcagatcgcggcggctgctgcggccgtggaggcggcggcaccggaggcgacgacgatcttccggtccaggctcccggacatcgacatcccgacccacatgcccctgcacgactattgcttcgcgacggcagcctcggccccggacgcgccgtgcctcatcaccgcggccacggggaagacctacacgttcgccgagacgcacctgctgtgccgcaaggccgcggcggcgctgcacgggctcggcgtgcgccacggggaccggatcatgctgctgctccagaactccgtggagttcgcgctcgccttcttcggcgcgtccatgctcggcgccgtcagcacggcggcgaacccgttctgcacgccgcaggagatccacaagcagctcgtggcctccggcgcgaagctggtcgtcacgcagtccgcctacgtcgacaagctccggcacgaggccttcccccgaatcggcgaggccctcaccgtgatcaccatcgacgaggacgacggcaccccggacggctgccagccgttctgggccctcgtgtcagccgccgacgagaacagcgtcccggagtctcccatctcgccggacgacgcggtggcgctgccctactcgtcgggcacgacggggctgcccaagggcgtggtgctgacgcacggggggctggtgtcgagcgtggcgcagcaggtggacggcgagaacccgaacctgcacatgcgggcgggggaggacgtggtgctctgcgtgctgccgctcttccacatcttctcgctcaactcggtgctgctgtgcgcgctgcgggcgggcgccgccgtgatgctgatgcctaggttcgagatgggggccatgctggagggcatcgagcggtggcgcgtcacggtggcggccgtggtgccgccgctggtgctcgcgctcgccaagaaccccggggtggagaagcacgacctcagctccattcggatcgtgctctccggcgccgcgccgctcggcaaggagctcgaggacgcgctacgtggccgcctgccgcaggccatcttcggacagggctacgggatgacggaggccgggccggtgctgtccatgtgcccggcgttcgcgcgggagccgacgccggccaagtccggctcgtgcggcaccgtggtgcgcaacgcccagctcaaggtggtcgaccccgacaccggcgtctccctcggccgcaacctccccggcgagatctgcatccgcggcccgcagatcatgaaaggatacttgaatgatcccgtggccacggccgcgaccatcgacgtcgaggggtggctccacaccggcgacatcggctacgtcgacgacgacgacgaggtcttcatcgtcgaccgcgtcaaggagctcatcaagttcaagggcttccaggtaccgccggccgagctcgaggctctgctcatcgcgcatccgtccatcgccgacgcggccgtcgtcccgcaaaaggatgatgccgccggcgaggtcccggttgccttcgtggtccgcgccgccgactccgacatcgccgaggaggccatcaaggagttcgtatccaagcaggtggtgttctacaagaggctgcacaaggtctacttcacccacgcgatacccaagtcggcgtcggggaagatactcaggaaagaactcagagctaaactcgccgccccggccactgcctgaagagtggttcatggcttcatgctaatcatttcgatcagaaaggcacttctagcatatatgttccaccttttgtttcatttggaagattgtattccagctagtggccagtgactgagtaagggatggggataaaagttttgtctacgttttcttttacgctactctctccattggggagtacaatgtatcaggggattcgtgattgaagttaatcaagattggttcaattataaaaaaaaaaaaaaaaaa

SEQ ID NO: 2 - protein, 606 aa, Lolium perenne
MITVAAPEVQQPQIAAAAAAVEAAAPEATTIFRSRLPDIDIPTHMPLHDYCFATAASAPDAPCLITAATGKTYTFAETHLLCRKAAAALHGLGVRHGDRIMLLLQNSVEFALAFFGASMLGAVSTAANPFCTPQEIHKQLVASGAKLVVTQSAYVDKLRHEAFPRIGEALTVITIDEDDGTPDGCQPFWALVSAADENSVPESPISPDDAVALPYSSGTTGLPKGVVLTHGGLVSSVAQQVDGENPNLHMRAGEDVVLCVLPLFHIFSLNSVLLCALRAGAAVMLMPRFEMGAMLEGIERWRVTVAAVVPPLVLALAKNPGVEKHDLSSIRIVLSGAAPLGKELEDALRGRLPQAIFGQGYGMTEAGPVLSMCPAFAREPTPAKSGSCGTVVRNAQLKVVDPDTGVSLGRNLPGEICIRGPQIMKGYLNDPVATAATIDVEGWLHTGDIGYVDDDDEVFIVDRVKELIKFKGFQVPPAELEALLIAHPSIADAAVVPQKDDAAGEVPVAFVVRAADSDIAEEAIKEFVSKQVVFYKRLHKVYFTHAIPKSASGKILRKELRAKLAAPATARVVHGFMLIISIRKALLAYMFHLLFHLEDCIPASGQ

SEQ ID NO: 3 - DNA, 1992 bp, Lolium perenne
cggcacgagcgccattcctccaccttcagctccggccaaagatttccatccggcgagatccatgggctccatcgcggcggacgcgcctcccgcggagctggtgttccggtccaagctcccggacatcgagatcccgacccacctgacgctgcaggactactgcttccagcgcctgccggagctctccgcgcgcgcctgcctcatcgacggcgccacgggcgccgcgctcacctacggcgaggtggacgccctgtcccgccgctgcgccgcggggctgcgccgcctcggcgtcggcaagggcgacgtcgtcatggcgctcctccgcaactgccccgagttcgccttcgtgttcctcggcgcggcccggctcggcgccgccaccaccaccgccaacccgttctacacgccccacgagatccaccgccaggccaccgccgccggggccagggtcatcgtcaccgaggcctgcgccgtcgagaaggtgcgcgccttcgccgccgagagagggattcccgtcgtctccgtcgacgagggcgtcgacggcggctgcctcccgttcgccgagactctgctcggggaagaaagcggggagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtcggacgtgctgctgtgcgtgctgccgctgttccacatctactcgctcaactcggtgctgctcgccggtctccgcgccgggtgcgcgatcgtgatcatgcgcaagttcgaccacggcgcgctggtggacctggtgcgcacgcacggcgtcaccgtggcgccattcgtgccgcccatcgtggtggagatcgccaagagcgcgcgggtgaccgccgcggacctggcgtccatccggctggtcatgtcgggggcggcgcccatgggcaaggagctgcaggacgcgttcatggccaagatccccaacgccgtgctcggccagggatatgggatgaccgaggccggccctgtgctggcgatgtgcctggccttcgccaaggagccgttcgcggtcaagtccggttcctgcggcaccgtcgtcaggaacgccgagctcaagatcgtcgaccccgacaccggcgcctccctcggccgcaacctgccgggggagatctgcatccgcggcaagcagatcatgaaaggttacctaaatgatccggtggccacaaagaacaccattgacaaggacggttggctgcatactggtgacattggttatgtcgatgatgacgacgagatctttattgtcgacagactgaaggagataattaaatataagggattccaagtacctccggcggaacttgaagcccttctcattacacaccctgaaatcaaggatgctgctgtcgtatcgatgcaagacgaacttgctggtgaagttccggttgcgtttgttgtgcggactgagggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccagcagtaataccacacagtccaaaagctaagtcagatatattgtttcccaaccttacacacctctgtccaacaccatgtaatgttcttaatataaacggaaattattacatatagaagggctgattctttttactagatgtgtccaacatatgatatgcttgttaggccgatgatgtgtaacctgtcatgtatagataccgcctttttttgacaagaaaggctgattataatgtataccgtgaactgaatatttgttcagggagatcaaaaaaaaaaaaaaaaaaaaaaa

SEQ ID NO: 4 - protein, 556 aa, Lolium perenne
MGSIAADAPPAELVFRSKLPDIEIPTHLTLQDYCFQRLPELSARACLIDGATGAALTYGEVDALSRRCAAGLRRLGVGKGDVVMALLRNCPEFAFVFLGAARLGAATTTANPFYTPHEIHRQATAAGARVIVTEACAVEKVRAFAAERGIPVVSVDEGVDGGCLPFAETLLGEESGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRTHGVTVAPFVPPIVVEIAKSARVTAADLASIRLVMSGAAPMGKELQDAFMAKIPNAVLGQGYGMTEAGPVLAMCLAFAKEPFAVKSGSCGTVVRNAELKIVDPDTGASLGRNLPGEICIRGKQIMKGYLNDPVATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPSSNTTQSKS

SEQ ID NO: 5 - DNA, 2038 bp, Lolium perenne
cggcacgagatctcccacgactaatttagaagaagatttacttagtctctgcttctcgctcgatcgccggccggtgaggtagctagctagctactcgtactagaccattaccatgggttccgtgccggaggagtcagtggtggcggtggcaccggcggagacggtgttccggtcgaagctccccgacatcgagatcaacaacgagcagacgctgcagagctactgcttcgagaagatggccgaggtcgcgtcccgcccctgcatcatcgacggccagacgggcgcctcctacacctacacggaggtcgactccctgacccgtcgcgccgcggcggggctgcgccgcatgggcgtggggaagggcgacgtggtgatgaacctgctgcgcaactgcccggagttcgccttctccttcctgggcgcggcgcggctgggcgccgccaccaccaccgccaacccgttctacaccccgcacgagatccaccgccaggcggaggcggcgggcgccaagctgatcgtgaccgaggcctgcgccgtggagaaggtgctggagttcgcggcggggcggggcgtgcccgtggtcaccgtcgacgggaggcgcgacgggtgcgtggacttcgcggagctgatcgccggcgaggagctgcccgaggcggacgaggccggggtcctccccgacgacgtcgtcgccctgccctactcctccggcaccaccgggctccccaagggcgtcatgctcacccaccgcagcctcgtcaccagcgtcgcccagctggtcgacgggtcgaaccctaacgtgtgcttcaacaaggacgacgcgctgctgtgcctgctgccgctcttccacatctactcgctgcacacggtgctgctggcggggctccgcgtcggcgccgccatcgtcatcatgcgcaagttcgacgtcggcgcgctggtggacctcgtccgcgcgcaccgcatcaccatcgcgccattcgtgccgcccatcgtcgtggagatcgccaagagcgaccgcgtcggcgccgacgacctcgcatccatccgcatggtgctctccggcgccgcgcccatgggcaaggacctccaggacgccttcatggccaagatccccaacgccgtgctcggacaggggtacgggatgaccgaggctgggccggtgctggccatgtgcctggcgttcgccaaggagccgttcaaggtcaagtccgggtcgtgcggaaccgtggtgcgcaacgccgagctcaaggtcgtcgaccccgacaccggcgcatccctcggccggaaccagcctggcgagatttgcgtccgggggaagcagatcatgataggttacctgaacgacccagagtcgaccaagaacaccatcgacaaggacggctggctgcacaccggagacatcggcttggtggatgacgacgacgagatcttcatcgtcgacaggctcaaggagatcatcaagtacaagggcttccaagtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaacgagaacgagatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaagttgccgcgccgagaagctaagggccgcttctcaggaacgcagtcacccatggtgctgtttaggtgctgttatagaccacaccaaatggggaaagaaactacgggaggggatcatattattgttgcaggagatatcagtttgttgattcgccctgcttgtgtaatgttgataaaatgaaatgatataatagatgtgttgttttattttttgaccatgtaagaacaaggctgttttatacactacttattttttgaaaaaaaaaaaaaaaaaaa

SEQ ID NO: 6 - protein, 557 aa, Lolium perenne
MGSVPEESVVAVAPAETVFRSKLPDIEINNEQTLQSYCFEKMAEVASRPCIIDGQTGASYTYTEVDSLTRRAAAGLRRMGVGKGDVVMNLLRNCPEFAFSFLGAARLGAATTTANPFYTPHEIHRQAEAAGAKLIVTEACAVEKVLEFAAGRGVPVVTVDGRRDGCVDFAELIAGEELPEADEAGVLPDDVVALPYSSGTTGLPKGVMLTHRSLVTSVAQLVDGSNPNVCFNKDDALLCLLPLFHIYSLHTVLLAGLRVGAAIVIMRKFDVGALVDLVRAHRITIAPFVPPIVVEIAKSDRVGADDLASIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEINENEIKQFVSKEVVFYKRINKVYFTDSIPKNPSGKILRKDLRARLAAGIPTEVAAPRS

SEQ ID NO: 7 - DNA, 1395 bp, Lolium perenne
ggcacgaggaatcctaccaaaccgagctaccagatccttctctactaatcgagctccctacgctgctccgcctgtcttcgtttccgcctcaccgccggccggttctccgctccaagctacgtccgtccgtccacatatatagcatcgacatgaccatcgccgaggtcgtggctgccggagacaccgccgccgcggtggtgcagcccgccgggaacgggcagaccgtgtgcgtgaccggcgccgccgggtacatcgcgtcgtggctcgtcaagctgctgctggagaaggggtacaccgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcgtcccccgtcaccgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgccagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccaccaggtgctctgatgagacgaacccgaggaagcagccatacaagatgtcgaaccagaagctccaggacctcggactcgagttcaggccggtgagccagtccctgtacgagacggtgaagagcctccaggagaagggccaccttccggtgctcagcgagcaggcagaggcggacaaggaaaccctagctgccgagctgcaggcaggggttaccatccgagcatgaggaacaagaaatcaaccatgtccatactgctactgtcatgtaaaccagctgttgaatgcctaaaatctaagttcttgtaatactgtgttgtttcatgtggactagattgatcgaataaacatctctacacaaggttgctaaaaaaaaaaaaaaaaaa

SEQ ID NO: 8 - protein, 362 aa, Lolium perenne
MTIAEVVAAGDTAAAVVQPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDETNPRKQPYKMSNQKLQDLGLEFRPVSQSLYETVKSLQEKGHLPVLSEQAEADKETLAAELQAGVTIRA

SEQ ID NO: 9 - DNA, 1325 bp, Lolium perenne
ggcacgagcaacaagtcatcaatggcggaaggcttgccggcgctcggttgggctgcgagggacgcctccggtcacctctccccttacagcttctcgagaagcgttccgaaggacgacgatgtgacgatcaaggtgctcttctgcgggatctgccacactgacctccacatcatcaagaacgactggggcaacgccctctaccccatcgtcccagggcatgagatcgtgggcgtcgtcgccagcgtcggcagcggcgtcagcagcttcaaggccggcgacacggtgggcgtgggctacttcctcgactcctgccgcacctgctacagctgcagcaaggggtacgagaacttctgccccaccctgacgctcacctccaacggcgtcgacggcggcggcgccaccacccagggcggcttctccgacgtcctcgtcgtcaacaaggactacgtcatccgcgtcccggacaacctgcccctggccggcgcggcacctctcctctgcgccggcgtcacagtctacagccctatggtggagtacggcctcaacgcccccgggaagcacytcggcgtcgtcggcctgggcgggctcggccacgtcgccgtcaagttcggcaaggccttcgggatgaccgtcaccgtcatcagctcctcggacaggaagcgcgacgaggcgctcggccgcctcggcgccgacgccttcctcgtcagcagcgaccccgagcagatgaaggcggcggcgggcaccatggacggcatcatcgacacggtgtccgcgggccacccgatcgtgccgctgctcgacctgctcaagcccatggggcagatggtcgtggtgggcgcgcccagcaagccgctcgagctcccggccttcgccatcatcggcggcggcaagcgcctcgccgggagcggcaccggcagcgtcgcacactgccaggccatgctcgacttcgcgggcaagcacggcatcaccgccgacgtcgaggtcgtcaagatggactacggtcaacaccgccatcgagcggctagagaagaacgacgtcaggtaccgcttcgtcatcgacgtcgccggcagccacctgcagggcaccgccgcttaacttgtgctacacaatgtggacgcgcgctcgtttggtccagaaaaaggttcgccggctcacagccacatgaacaagtcaatgagtcgttggtgtgttgtttatcttcattccacatatgggacgcagttccagattttcatgtcaaataattgcgtcgtgtgcggttgtcaagactcaaataggagaaaaaaagactcgtgatttcgttttgcaaaaaaaaaaaaaaaaa

SEQ ID NO: 10 - protein, 407 aa, Lolium perenne
  MISC_FEATURE (181)..(181): any amino acid
MAEGLPALGWAARDASGHLSPYSFSRSVPKDDDVTIKVLFCGICHTDLHIIKNDWGNALYPIVPGHEIVGVVASVGSGVSSFKAGDTVGVGYFLDSCRTCYSCSKGYENFCPTLTLTSNGVDGGGATTQGGFSDVLVVNKDYVIRVPDNLPLAGAAPLLCAGVTVYSPMVEYGLNAPGKHXGVVGLGGLGHVAVKFGKAFGMTVTVISSSDRKRDEALGRLGADAFLVSSDPEQMKAAAGTMDGIIDTVSAGHPIVPLLDLLKPMGQMVVVGAPSKPLELPAFAIIGGGKRLAGSGTGSVAHCQAMLDFAGKHGITADVEVVKMDYGQHRHRAAREERRQVPLRHRRRRQPPAGHRRLTCATQCGRALVWSRKRFAGSQPHEQVNESLVCCLSSFHIWDAVPDFHVK

SEQ ID NO: 11 - DNA, 1378 bp, Lolium perenne
  misc_feature (870)..(870): any nucleotide
ggcacgagtcgcctccaacgtcttcccttaaccggccgtccctacgcttgcaccaccaccacgcacagacagagcagtttcccagcccccgccggaaccggatggcacccacggcggcggagcagacggagcaccaccagcacaccaggaaggcggtggggctggcggcgcgcgacgacgccggccacctctccccgctcgccatcacacggaggagcacaggagacgacgatgtggtgataaagattttgtactgcggaatctgccactctgacctgcacgccctgaagaacgactggaagaactcaaggtacccgatgatccccgggcacgagatcgccggcgaggtcacggaggtgggcaagaacgtgagcaagttcaaggccggcgaccgcgtgggcgtcgggtgcatggtgaactcgtgccggtcgtgcgagagctgcgacaagggcttcgagaaccactgcccgggcatgatcctcacctacaactcggtcgacgtcgacggcaccgtcacctacggcggctactccagcatggtggtggtgcacgagcggttcgtggtccggttccccgacgccatgccgctggacaagggcgcgccgctgctgtgcgccggcatcaccgtgtacagccccatgaagtaccacgggctcaacgttcccgggctgcacctcggcgtgctggggctgggcgggctgggccacgttgcggtcaagttcggcaaggccttcggaatgaaagtgacggtgatcagctcgtcgccggggaagaaggaggaggccctggggcggctgggcgccgacgcgttcatcgtcagcaaggacgccgacgagatgaaggctgtgatagcaccatggatggcatcantaaacacggtatctgcaaacatccccctgacccctctcttcgggctgctcaagcccaacggcaagatgatcatggtcggcctccccgagaagcccatcgagattcctcccttcgctctagttgccacgaataagaccctggccgggagcatcatcggcggcatgagcgacacgcaggagatgctggacctcgcggcgaagcacggcgtgacggccgacatcgaggtggtcggcgcggagtatgtgaacacggccttggagcgccttgccaagaacgacgtcaggtatcgcttcgtcatcgacatcggcaacaccctcgacaatgttgcggccaccaccgagtgaacgtactcagcactgcttacgatctacgttgttccactgttagtgctccgtagtaaacaataaacgatcaaaactcttgtcatctggtgcattggtgtagacatggttgtttgcgaggaaactgagttgaaggatggatggataaaaaaaaaaaaaaaaaaaaa

SEQ ID NO: 12 - protein, 370 aa, Lolium perenne
  MISC_FEATURE (257)..(257): any amino acid
MAPTAAEQTEHHQHTRKAVGLAARDDAGHLSPLAITRRSTGDDDVVIKILYCGICHSDLHALKNDWKNSRYPMIPGHEIAGEVTEVGKNVSKFKAGDRVGVGCMVNSCRSCESCDKGFENHCPGMILTYNSVDVDGTVTYGGYSSMVVVHERFVVRFPDAMPLDKGAPLLCAGITVYSPMKYHGLNVPGLHLGVLGLGGLGHVAVKFGKAFGMKVTVISSSPGKKEEALGRLGADAFIVSKDADEMKAVIAPWMASXNTVSANIPLTPLFGLLKPNGKMIMVGLPEKPIEIPPFALVATNKTLAGSIIGGMSDTQEMLDLAAKHGVTADIEVVGAEYVNTALERLAKNDVRYRFVIDIGNTLDNVAATTE

SEQ ID NO: 13 - DNA, 5119 bp, Lolium perenne
  misc_feature (10)..(10): any nucleotide
  misc_feature (38)..(38): any nucleotide
  misc_feature (79)..(79): any nucleotide
  misc_feature (592)..(592): any nucleotide
  misc_feature (2154)..(2154): any nucleotide
  misc_feature (2293)..(2293): any nucleotide
  misc_feature (2314)..(2314): any nucleotide
  misc_feature (2332)..(2332): any nucleotide
  misc_feature (2394)..(2394): any nucleotide
  misc_feature (2420)..(2420): any nucleotide
  misc_feature (2422)..(2422): any nucleotide
  misc_feature (2434)..(2434): any nucleotide
  misc_feature (2564)..(2564): any nucleotide
  misc_feature (2566)..(2566): any nucleotide
gcagcggttncaaatcgccggtcctggggtggaagtgnagcagtgggaagatgtgtgcgaggggttgtgttttggatgnaagacaggcgggccagtggagaacaagagagaacgcgagaggccaaagtatccgcagccccgcaaacaaggcctagatttgggttaagtttgggtcgtctcagacaccgcggccatccttttaggtggtccgcgcgctggaccgtatttttatctgagttgacccattcagacgcgcagacacgagatggatggtgcagtwagagatgacctaagtacaaraacctctccccgagctgccgccatccgtcacttaccgagcgacaaagcttcccacttcatcacactcagcccagcaagcatactgatggtgagcgcactcgcggctgtgcccaccgaccccacgccatccaaaaccaactctacttttcaccmcaccaacaaaagacaaaatatggtggattttgtgatgagatggaagcggagcttgtcagaatgggaaacgcataaatcgagaacacgtatacagtgctggaaattggatgactaagccccaagggttagaaaaaaaatnagaccatgtctagatggaattagacattttttgatataatagaagcgggacttggcgcgacaatttcaaacttcgtccctaacaggtatcgaactttcgatagttagcgtgtgctactgcggacccccaaccacttgtgttaagcccacatcggttaaggcccaagggttagatgaaagtaccaatctcactcatttgcgactagctacaaaacttgcttttcacatgtacggtcatactacaattttgaccttggtaacgtaagtatggactgtatggtgtgctaaggtgtgttggcagctcaaataaacccaaaaatttcaacacacgtcaaccatgaactgagattcacaccaacggctgagccgtctcctttaaaagatagagggagaaaaccataatcaccattggtggtcatgtgtgagtgtgcaagcaaaaaaaaatggagaagccaaaacccgttgagagagtgcgagagcatacaagaacaccacaacaaagtgtgaaggagaaaaagaatatgagataagatttcggaaatacttttgcacacccatgcatgggtgtgggtgtttccgtcaccgtctatgtatttctcgaaattcatgcccaccatggtagataaaaatatttttttctctctcctctttttattcaaatctcaaagcataakrartggtgacagaacgataagattcctacctagctttctgagatcccactagtttatcttcaagctggtgattgaaggattaaccatgcttgaattagattggcttcaaacttggtagtagcttgtttcatactttgattactttggtatggttagttggtttgagattttggtcaatgtagaatcagatttgagagcgattgtcagcttgaattgccgcagttttagcacatactagtttggatagatgaacagtttggagagacaaataatgtctatacgagctcatcggataatattagtctatggcttttgcttcggtgtcccctctgcaaactttacccctctgtagatggtaggattttctgatatcctttcatggtttaagggtgtgcgtgtaaggaacgggagataccggatcacaccttttcgtctacactttacaagcatgtaacacctaagattgattgatatctaggcttacaccccaatggaggtaaactaatattattgaaatgcgacttttcaaaagtcccaatataaccttgacgatgatcttacaactactcgcgccagtcttgtatgatatcagattggccgaggatcgtgggtaccttgtagtggactatgatgctcatggaggttgtatggacatgttgtaatgctggttttctctaggttttttctaatcaacttggcattcttctccttaacacataataagagggaatacctccatacattattctgaaaaaagcatggccaacaatgaaacagaaacaagtacgacagtctatacccgacccaaacaatggctcaggtctttcacgatgcatagtttgttagcatgtattttatagtaggaactaaaatttaaagacaacttgcnaaaacaattttgtctcttgagtgttttttaaggatgcggcatttatcgattatacattacatatgtgattggattagccaactttttgtcttccgatgatcatatgaaagggttgtatcttagggcatctccaatgggnagactcaaatgcaaaaaaatngtccgtttgggtcttccnggacaaaacctgctcccaacggggcaacccaacttaaaaacggacaggtgcagcgtccggcntgacccaaaactgacgcaaatttggnanatttttggggcnagccagacgaacgcgggcgtccactgtatccgactatgtccgcatcctggcccatctgacagtgacacaaaatacaaccacatgcgccccccacccttctctctcctccgttcgccttttcccatggaancngtcctcgctcctcgccggaattgatctcgcctaaccatgctccgccgccaccctcgcctkaaggccccagccgccgctacctcctttttgtcagccctattggaagtcgccggagttgaaacgagcgccgccagcctcgacaccgccgagcaagacgaagactgggcggagctcgccgagacgggacggggacggagctcgccatgcgtgcctcgcaggggcgcgatgggggcggagctcgccgtggctggctgcagcacctcgggccgctgctagccgtgccacgacgcgagcatgcgcctcgacgccgccccgtgctacctcgtcgcgcgcccagggccgccccgcccctgccgaccggcggcggagacgcgaccttcgcggacgtgcccggcggcagagacgcgtccttcgcgacagcgccctcctcgatctccgtcgagccgcatacgcggctaggagggacgcgggcgtccccggtgtcggcctccgttgtggcgcatcgcgggcgcggcctccgtcgaggcgcatcgcgggcgtggcctcgtggcgcagcctgccctgattcggtctgaggcgcggcgcggagcttcctcgcggcggcgcgggcggagcctcctcgctgcggcgcgacctgctctgccgcggtccgagacgcggcgcgggcagagcttcctcgcggcggctcgggcgcggcttcctcgcggcgatggcgcttccaggctcgcacgcggcctccggcgtggcgcagcgagagcgcagcctccggtgagttaggcacaggcgcgacacgacatccccggcctcggcctccggcgtggcgcagcgcgagcgcgacgtagcctaggttggcaactagtactacgaggaagaaagaggagaaacaattatttgggtcacagcgttgggcgtactgtgcgatccaaacggacacccggacgcgaaacgatgtcagcgtgtccgcgtggcgacccaaacgacccgaaacggacgtccgtttgggtcggtgcgttggagatgcccttactccccatcctcaaatgagtctaattatatatcttgttgtaagttttaaaaaagttaaactttgatcaacattagtaatgatagtagcaacgaatacaaaattaaattgtaaaaatatattatgaaactttattttaagatggatctagttatactaattttctgcggatggaggaagtagctaaatattgttaatttctaaataaaaaattaaaactttaacttaaaacaaaagttacaagcataattatctgtggatggaggaagtagctaagatacaccaatcctctctctacattacctagcatgccacatcaggaaactatttaggataagctccaaggaaccacccagaacaacaatttacatggcctggctaacctaatgacaatttccgagcaactggtggtggtggtacgcgttccttgttcaattgtctctattacaagagtggccctgtataggtaaaaaaaaataacaagcttccaaggacggccatgttccttgttcctgcaggctgcacgtactcacgacgaagtgtatctcgtgttctggacatttgtctcgcgcattttgtaaccatgaaattaaaaatgtggtggcctgctatatctgtatgggggtatcatgcactccttcgcagaggaatccagacgacgatttacacgtgtttccaccttagctttttttaagtgtgtgtgtaaggaacgatcatataactgcccctgaatgctgcatatatataaaccgactccatcatgtactcgagacaaggtcgtcaagaaaaacaaactatgcctatctcactagcaatgatttgagagtacagcttttccggtgccatattttttcctatatatctttttctgaagaacaagaaaaaaaaaacagttggtgtggtggttggtgaagcgagaaagccccatataagccctgctcaccctccccgcaaagcacaactcatagctcgggtctctcgctcacaccaaaatcgcccaccagcaccagcatctctcgatcggcagacgcatagatcgatgggctccaccgccgccgacatggccgcgtccgcggacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtgagtctctcagtggagctagttactgtagatccgaattcgttccctttagtgagggttaattccgcggccgcgtcgac

SEQ ID NO: 14 - DNA, 4555 bp, Lolium perenne
tcccgtatcttcaacgtgacacccctacacttcctgcttgtcttggagatttacacacacacggcaattaccaggagtatcttcctagattatttttttcgataaggatcttccagatatagcatgtgaatctctgtactactactgtttgtcaagcaaaattaacattgacatcagtgtttttgttgggggcagcggaatctttgacgcctcttcttgcctctcaagacatgtcaccctcactagttagtgtgccagctggtagtactacgtacgatgctccctccctccgtaattattcaacctttttgctctctctttttataaagtcaaaccttttaaatctgaccagatatctgctaaaaaattagcagacatgcatacatcaaagcagtagtcctccctccgtttaaaattacctgggtttattcaaataaagtcaaactctgtaaaattcaattaaatatttagaaaaatctaacagcacctgtagtataaaagtatgctccctctgtttgtaaaaaagctaagcaacttttttgagatacggataaatctttagctaaaacatgtctatatacctttgtatctagataaagttggaaagcttttttagaaacagacaaagtatgtgtttgacattatgaatgttgagtatttttcctctaatcttgatcaaattttacaaattttggcttgaatagagggaccattattagtatgaaactacataaatttgtaaaacactcaacataatttacgatgggtcagtgatagcactaacttagcttttcataaatgccactgcttttcaatagagcatgaagcaggacaaatttattcgtgtgacttgaatagagggagcctgttctggttcaactcaccctgcatgtgtgtcttcatcccttttgctcttcctatctgtggtgtcaattgagtgtcccacgtgcatgtgggcgaaacttgaacctagaaattgacatgctcccactgcccggagcggagtatctttgtgctttgttacccttattgttgctacgtactacagtgtttagattggaacttcataatcaaaagaacttagtttcctacaattttttgctaagcaatataatgagcaatcaaacttctatatctgtggcaaataactaatccattatagttacagtttagatgcagacgccagtgtttcttccccttttcggaaaaaagctattccataataagtgttggaaatttaataaatgggtactacgaatttgaaaaaaaaagtgtcaaaaattcactaagaaagtacgtagtacaaatttaaactaagattccgacacttattaggatcggagagagtaagtagcaaactactactccatccacctaaaacacgtgatttaactttgtctagatacggatagaaagttgggatacatccgtatcttaaaaaaaaacgcacttattttagacgaaggagggagtatttcaaccttgattttaaacggaatctacaaagggaatacatggattgtacaagtgggctgaccgtatccattatgtactcgtactttgcagtttgaaagcaaaggctagtgtaatttgtaggtggttctaggcgtctagctgtttcatggcgttatcacagccgtgccagtgtgctcagggccgtacataagttgcttggtgtatgtgtcgatctaggatttgccgtcttacaattttgctttccaacttattttctgtaaagagatcgatgtgaacttctctgtcgagtaaactgaaattgtctgaataaatataactcggcagattatgttttatcgtttgcatgcgtaacaggctacacaaattgctcgagtcagcagcgagttgagctcacaacgaatccatcagcaaaaatactatactatagtagcacatcgtttcttttttcatgacgtttctgtttcttcctaactttccaggagcaccggagacgacgatgtggtgataaagattttgtactgcggaatctgccactctgacctgcacgccctgaagaacgactggaagaactcaaggtacccgatgatccccgggcacgagatcgccggcgaggtcacggaggtgggcaagaacgtgagcaagttcaaggccggcgaccgcgtgggcgtcgggtgcatggtgaactcgtgccggtcgtgcgagagctgcgacaagggcttcgagaaccactgcccgggcatgatcctcacctacaactcggtcgacgtcgacggcaccgtcacctacggcggctactccagcatggtggtggtgcacgagcggttcgtggtccggttccccgacgccatgccgctggacaagggcgcgccgctgctgtgcgccggcatcaccgtgtacagccccatgaagtaccacgggctcaacgttcccgggctgcacctcggcgtgctggggctgggcgggctgggccacgttgcggtcaagttcggcaaggccttcggaatgaaagtgacggtgatcagctcgtcgccggggaagaaggaggaggccctggggcggctgggcgccgacgcgttcatcgtcagcaaggacgccgacgagatgaaggtaggcggacccgctggttcaggttacttcccctgtccggtgcagaagaaagaggaacttgagggttcatgtttgttttgcgttggtgatgtctttgcaggctgtgatgagcaccatggatggcatcataaacacggtatctgcaaacatccccctgacccctctcttcgggctgctcaagcccaacggcaagatgatcatggtcggcctccccgagaagcccatcgagattcctcccttcgctctagttgccagtaagtcttaggatctcttgcaataaggagaaatcatgcactgatcgatcagagaaatgagatagcatcctgatgaacattgtacgtgtgtgcagcgaataagaccctggccgggagcatcatcggcggcatgagcgacacgcaggagatgctggacctcgcggcgaagcacggcgtgacggccgacatcgaggtggtcggcgcggagtatgtgaacacggccttggagcgccttgccaagaacgacgtcaggtatcgcttcgtcatcgacatcggcaacaccctcgacaaggttgcggccaccaccgagtgaacgtactcagcactgcttacgatctacgttgttccactgttagtgctccgtagtaaacaataaacgatcaaaactcttgtcatctggtgcattggtgtagacatggttgtttgcgaggaaactgagttgaaggatggatggataagtttgcttcttgccgtgttaatggattacctacttagcttcactgcaattaacaaattaagaaacgacacacccaaaagactttcgtcagttttcttggattatacaagtcgttatggttgggtgtcagtgtgtcacagataatcatactatggtatttaacctggaagatcgtttttttggcggcaactcagtgggttttcccactatgtatatttataaatattcaacaagtcatgaggtacaaagggttgttgctagaggatagcaacaagaagctagccaaaagatcataggcttaaaaaagagagaaaagaaaacaaaactgctatagttatcgaaatctctcagctcaaattttaaaaccagcataagactttctagaagccttatgaacaagaagagctagctcatctttaaaccttttcctgcatctgtaaagattgagggtgcaacccttgaatataaaatcattcctgtcatccagatagactatgtagtcaaaatagtcatttccatgaagaagggcacttttaatacatttttgagacttggtatgatactctgaatgtcaacaccctggaagatcttttcactcctatggaaggacaagaaagcatttcaactccttttactaaggaagagattgacaaggtgattcagagaattcctttagacactatagaaagtcacaaggtgccaacggcgcaatcctgtgccgacggctttttatcggggaagccagcatcggtaccgagaccggcagcccaccaactaggccgtcggcacacatcctccagtgtcggcggccaacatcggcataagttggcccgttgggcatcaactcccccgtcggaacaggtctagcgcatggaccgtcgtgatggcggcggcaacgacgtcatcctatgccgacggcctagccgtcggcctagcttgccagcgctatgccgacgtcacattgccatcggcacatgctagtttttttttcttttttctacatgccaaattgtatatgtatatatactcatttacttattacttccaattattttaatgtgtatatattttgctcaccaattgtacgaatttgtaccctccgagaaattgctaaaatgatggagtgacctacaacgagccttggatatgtgagttcttcttgccccattgcacaaaaattgtaaatattagggtttactggatccactagttctagagcggccgccaccgcggggagctccagcttttgttccctttagta

SEQ ID NO: 15 - protein, 312 aa, Lolium perenne
RSTGDDDVVIKILYCGICHSDLHALKNDWKNSRYPMIPGHEIAGEVTEVGKNVSKFKAGDRVGVGCMVNSCRSCESCDKGFENHCPGMILTYNSVDVDGTVTYGGYSSMVVVHERFVVRFPDAMPLDKGAPLLCAGITVYSPMKYHGLNVPGLHLGVLGLGGLGHVAVKFGKAFGMKVTVISSSPGKKEKAVMSTMDGIINTVSANIPLTPLFGLLKPNGKMIMVGLPEKPIEIPPFALVANKTLAGSIIGGMSDTQEMLDLAAKHGVTADIEVVGAEYVNTALERLAKNDVRYRFVIDIGNTLDKVAATTE

SEQ ID NO: 16 - DNA, 1378 bp, Lolium perenne
ggcacgagtcgcctccaacgtcttcccttaaccggccgtccctacgcttgcaccaccaccacgcacagacagagcagtttcccagcccccgccggaaccggatggcacccacggcggcggagcagacggagcaccaccagcacaccaggaaggcggtggggctggcggcgcgcgacgacgccggccacctctccccgctcgccatcacacggaggagcacaggagacgacgatgtggtgataaagattttgtactgcggaatctgccactctgacctgcacgccctgaagaacgactggaagaactcaaggtacccgatgatccccgggcacgagatcgccggcgaggtcacggaggtgggcaagaacgtgagcaagttcaaggccggcgaccgcgtgggcgtcgggtgcatggtgaactcgtgccggtcgtgcgagagctgcgacaagggcttcgagaaccactgcccgggcatgatcctcacctacaactcggtcgacgtcgacggcaccgtcacctacggcggctactccagcatggtggtggtgcacgagcggttcgtggtccggttccccgacgccatgccgctggacaagggcgcgccgctgctgtgcgccggcatcaccgtgtacagccccatgaagtaccacgggctcaacgttcccgggctgcacctcggcgtgctggggctgggcgggctgggccacgttgcggtcaagttcggcaaggccttcggaatgaaagtgacggtgatcagctcgtcgccggggaagaaggaggaggccctggggcggctgggcgccgacgcgttcatcgtcagcaaggacgccgacgagatgaaggctgtgatgagcaccatggatggcatcataaacacggtatctgcaaacatccccctgacccctctcttcgggctgctcaagcccaacggcaagatgatcatggtcggcctccccgagaagcccatcgagattcctcccttcgctctagttgccacgaataagaccctggccgggagcatcatcggcggcatgagcgacacgcaggagatgctggacctcgcggcgaagcacggcgtgacggccgacatcgaggtggtcggcgcggagtatgtgaacacggccttggagcgccttgccaagaacgacgtcaggtatcgcttcgtcatcgacatcggcaacaccctcgacaatgttgcggccaccaccgagtgaacgtactcagcactgcttacgatctacgttgttccactgttagtgctccgtagtaaacaataaacgatcaaaactcttgtcatctggtgcattggtgtagacatggttgtttgcgaggaaactgagttgaaggatggatggataaaaaaaaaaaaaaaaaaaaa

SEQ ID NO: 17 - DNA, 2650 bp, Lolium perenne
cgggatcaacttggatgtcctttgcgggcacggtttcaggaacaacgacacatgcagcagggatctcctccaaagactcacacaaaggtgacatgagcgcccgcttttttgaagccaagttggctaagaaatcgcaaagcttggtggagtcggccacctcaggatctgcaacaaaaggcaccaagggagctgccaacacatcaaccacaacatcatgttcaaacgcagtctcctcaagcctcgaatgctcaaccgaaagagaggcagaagcttcaacaaaaaactcagccaacccaaagccctcgacgtcatcagagattaggctctgaggacccgcagggaagcaaccttgtcaacaaccgcatccggcagaaaaggagcaagaccggagcaaccctcaagaggcacacgaaagacgtcgaagccaagaggagacgagtcgcagggacggcggacaggcgagaaggggccgtagaactccaagagctcggcgtccctcgacctagcatccgaagcactgaccggggcactcaatgcataactttatcttgatggcatatgtactcaaacccatacaatgttcaccatgcattatctatggaacattccttcatatacaacttctgagtggtcagtgcataggaattttcattaacaaccaaaaacatacttggggcctacacacactttcacagcatggaaaacttgttagctttttaaagagttgcaaaatctgtcaagcgaatgttcttgtgataattggaacgaagcatgtttccccattttcaatgtgtgtctcttaccctaactagcacccgaccaacaaaatctgaccatcctagttatatcatcatagagacccacatgtaggttgacccccataacacttgtgtggatatcatggaaaatggccttgatcaacactttctttcctacttggtacaaatggttatggacttactcaattagtgctttagagagctttggctgcagactttgtagcttcccaatattcataggtccctccggagtgggcagccccatctacataggctcaaaaccagatttttgtaacatgttagacactttcaacttcatcatagaccatcaaggagctggcatgtgacagtgatatatgtatcaattacccattcaacacgaatagcttgctcatgcatggttagtcttgcggcggcggggcgggaccatcgaacacaccgccgggcggtcagtaggctagggttagataaaatctagccgttttcattcaaacttgtgatatataatcaaatttaaataaaaacctttattttcgtgcatttttatttatttgagggcgtgtttgggggacacggctggaaagtgacatccccaaacactgcacgaagaaaacgcgtcgccaaaaaattcgatccggcgtcagtcctttgggagacgatttggatgacgcggctagagatgctctaagttctccacgccatgtttctttctatatatacacacagcccaaggtccatgaaaagtaaaacggcacgacgacacgcaccggcgacaacttcacattacggcacatcgctattacggaccacatacaactccaccgctattctcagccaagtcatacatgacatgatccaatggacgactttgtgagcgaaactagaaccttgcggggtttagattttccaatgtggataagttgtacgcgccgactagctttacacttggttgaaaaaagcttattgtagcacgacttctcactgacataggaatgtaaacagtctctccacgccatgtttctttctagtagtagcatactagtagtaacttctctttgtcctacacacacccagggtccaagaaaggaaaacggcacgacggcacccaccgacgacgacgactccacatcacggttcggtaaaaaaagtcaaaactcgctgacgtggcaccaccggtcgcagtcaactgacgcgctcctctgcgcaggtytcacttcaagtttcacctaccactgtgggcccaccgccaatgtgggccccgcgagcttcttactcactgacctgtctcccaccagcctcctcgccggtatattaccccggcccccaatttcctctgccttcccacgagcagcagccggagcacggaatcccggccgccattcctccaccttcagctccgcccaaagatttccatccggcgagatccatgggctccatcgcggcggacgcgcctcccgcggagctggtgttccggtccaagctcccggacatcgagatcccgacccacctgacgctgcaggactactgcttccagcgcctgccggagctctccgcgcgcgcctgcctcatcgacggcgccacgggcgccgcgctcacctacgccgacgtggacgccctcacgcgccgctgcgccgcgggcctccgccgcctgggggtccgcaagggcgacgtcgtcatggcgctgctccgcaactgccccgagttcgccttcgtgttcctcggcgccgcccggctcggcgccgccaccaccaccgccaacccgttctacacgccccacgagatccaccgccaggcgaccgccgccggggccagggtcatcgtcaccgaggcctgcgccgtcgagaaggtgcgcgccttcgccgccgagagag

SEQ ID NO: 18 - DNA, 12175 bp, Lolium perenne
tcgacgcggccgcgtaatacgactcactatagggcgaagaattcggatcatatggattcgacactggaatttactcccatcgggagcgtgcaaacaaaaaggtgttatagcaagaagacactggcaacattgccagcacagaatttgttacaatcatagaaagttttatgacaggacattgtttcaaccgaaagcaagattacaacaatataatcaagggcttgggtctggttggacatgctcggtccaatggacgatttatttgccgagaccagctcaaggagttgacgagcacacttaagcgccgagatcttaaaggcacccaagtcaacaagtcgcccatcttgctcttttggcagctccttggacatctcttcgatattggctttgaagccatgacccatcataagctgaaaggctaggagggcaccataggtacgcgaagtacgtttgaatacctcgaggacctccctcgtgttgatggcgaaagcatcgatcagctgccccaaggtcttgttttgatcgatcttggggaagatcatcgagtgcatccgcgtcatggatcctttacccttctgaaggaggtcctgaaaaagctggtgagacccgagggtcattgacaaagcattcgccggagaattattcggcaatttatctagagcctcagcagggatgtaggcagcttctggagaaagtgaaagaggaggagctcactaaccaaaatcaaatcgataaagcaaaaatcggaaaggaggccaaaaggggattactgagcaaggccaaggaagattggcgaaggagctcatctttttcaatcgcccgagcttcggcagcaagcctggatgcctcttcatccttcagcctctttcttagcccctcgagctcatccttaaaggaatcaacctcctggcgggcctcggcagctatctttatcgcaccctccagcttcgaggaagaagactcgacctccttttgcagccgagtcttgtcaacttccagagaagtgtattgggaggcgaaggcctccagagaagagataacagctcacaaatccttaagagataaggaaaaataattagacgaagaactggttgtcaacaaacttataatttgatcagggaaatcgtcccacatggatatatcgttaaaacaggaaaagcttacaggtttccctggaggagaagctgtaaccacggcagtcaaagaaatctccttccctttggaaagggaagaagttgtcgatatttgagccatgggggctgcggcaggagtcgaagcctcggaagcggctggattcggcacgatggcaccagatttggccttcttggccggaggctcgatgaagccatcttcactgcaagaacaaaaaactagcgaagtcagaattcaatgcatatggcgaagttagaacacaatcctggaaaaggaagcaaggacttacaattcatagagaccatcttcatcggcaaagccgccggatgatctctttggaggtagtgcctcggccttttccgtagctgcatcaacaaaggcagcacgatcagcatcgtcatcatgcattgaccccgctgtatcgctcatatcatcggcagagaatcgaggattgatggaaaaagcctcaggattcatcggatcatcatgttgatctatcgggcttgcattccctagagtatgggaccctacaaggactaaggaatcccttttcttggaaaaattgttcgacaggtcttgcaaacgttcaagagccgtaaggatctgtcgtagttgacgagtgagaataatggcagttaaaataatcaaaggaacatgacaataagagcataaaggggaaatttacctcggttggcagatgaccagcgtcaaatggcggttgaggagatatcagtggaattgaatcttcctggctaaagagggtgagacaccggacttcgtcaagcagttctttttcggataattcagcaatatttactctagtctcgtccctgggacccgaatacaaccacatcggatgggtcctagacatgatcggctgaactcgatgttttaagaacacagcggctacctcagtacctatcatggtttgaccatcggattctttgatccgaaggaatctatcaaataacttgtctactgttggtttttcatcgggtgagaggatatttttccaagacttcttgggcttgcttctagaacatcggagaattgggggggagctgggagtcggctgctgatgagtccttaatataaaaccacttcagcctccagccttgcacggattctttcatcgggaagttgaagtagttgacttccttacgagcaacaaaaccaaccccaccaatgacgaaggacccaccactgctgttatatcttttcacgaagaaaatcttcttccacaaaccaaagtggggctcaatgcccaaaaacgcttcgcagagggtgataaagatggcaaggtgaaggattgagttgggggttaacttccataattgaatctcatacactcgaaggaggtggtgaagaaatttgtgagcgggaagcgaaagacctcggtacaagaaggataagaacatcacagtaaaaccggcaggaggattgggccgtgaaattgcacctggaagaataacattcccctcgtcagaagaaattattacgaggctccgggccctcttttcatctcgcttcgtggtggtagaagctggccaatcgccagggataggcccggccgtggagcttgacggcgctggcggtgccggagctgagggaggagcatctggcgcgcttctccgcggcggattcgaaggagccctgacggtggtgccactgctcacggcgctggtggcgagagtgggattcttcttcttcaccattgtgagatttgagggagatctgggagttgcgacggtggcgtggtagttgcaaacgaaaaggatgaatgaggaagaagggacgcaaggatgaagtgtggaaaggggagtttaccccaagagattataaagtgaaaggaaaacctgagaattgagcgggcacgtgtcgttgctctcaatttattgaggggattttttctcatcatagatcgcggaaatcgaggagtcaccttggtaactgcacgcaagtagtggtcatttcttaaacagaaccgcatagaagtaggatgggaccgtcaggtcacgtcctatcagtcagatttacaacagtaattacatcatcactgacgtcaaagtatgcttgaagtatccgaagaaaagtcgaaatttgggctcgaagactttcttgcagagaagcgcgtgaaaggaatatctaaggaaagggtcaaaacattcggctcgagtctacgcacggattgcaagcatccgtacctagactcgggggctactcccatcgggagcgctggacgtgcacccgataaatttagacgaggatgaaaaccggaaacccaagtgctactcccatcgggagcgccgattacgcacccgacaaacttttttgcactccaggatcatgcccggggacttaattctgtgtagagtagcgttgttttgtcttcggcagttaaccagcaaagctggacacgttactcaatatcctttacgcattaaacccttacttgaagaattgaagccccgatgcaaatatatcggatgacctatgaaggcctgcggaaagcttcgggagaagaagacattcgagtggcacaacttgagtctacgaacggattgcaagcatccgtacctagactcgggggctactcccatcgggagcgctggactcgcacccgatagaaggagatgatgatattacaagaaggacaagaagtatcaagggagaagaacattcggtggaggcatgctttagtctctacccgaaaaaacttcggctagacactcggggggctactgacgtgggcattacccttcgggtaactgatattgccctatcctgtacgacccaactggaggcccatgaagacactcgaaggcaaggtggaccactacgtcggtgccgaagggggttccttgaagaacaagacgaagaaaagaagaatacaagaaaagtatagaactaggatcttttgtaacctggtcgtacccggacagatctctcgagacctggccccctacatatgggctaggagaggggctgccgagagggacacacacaatcttagcaattttagccaccataagtccagagcaaggtccccgtagaacttagcctctcgacgagatcacagccgaaaccttcggcaccccattgtaacccgatattttcatagtcaagatcagacaggtaggacgtaagggttttacctcatcgagggccccgaacctgggtaaatcgctctccccgcttgtttgataaccgatggcttgtgtcagcttacatgattccatctaccctaaacctcaaacggagggcattgccgaggagtaccctcgacattcccctccaccaatggtctcacataaattcaacaaagcaaactcataaaaagtttaatgagtttcagaaagaaataaaactaggcccctcctttgagaatctacgaatgattcaccatatcatctcgcagttagtgatgagtaactaagtctcaaatttcccgacgcatggcgaaaaaggtagcgaacttaaaatgtgaggaatgaatgccacatatgcatggtgcatcgagtattctcattttagtcttggattactccctttagatgttgacaccatcccaaaaatacaacttggacaagttgttcatttcactagtatgaatttcagtaaatcgggcaatactccaacactcattcaccccctaggcgaggttagctcagatcaacgtcgggtgtcttcatcgagttaatgtcgtcacacgcacacacacgtacgcgcacacacacgtgcgcaaacaaaaagaaaactaggaaccttctcacgtagcctaggtcttgtcctgtaagaaaaaacccaggtccaccctagtttcgaaccaaaatatttttgaagatacattagtaagatatttttgaaaataaaaccgcaaaaagggaattgaaaaatatggactggctgttttgtccaaaaccacatctttcggagaaccacgagggtatctattgatgggctcatactatacctgggcatgtgttgggccaggcctcatgtcgggccgaggaaagcccgacgctgaaaaatcaggcccaagcttaacccggcccgaccaaatacccaccaaacccgttgggccatcaggttgcgggccgggcagtagtgtaaaacaccgatttcgggctacataggcccggctcgtttgtcgggcaaacatttctagacctaagcccgagtttttcgggccgggctgcccatggccaggtatagctcataacgacgtatgacatttcgagcaattgatgcaaagcacgtgtagggttttatcccatccgtgtggcgtgtgtagggtgtaaatgaataggataatttcctcgccgaaactggtcccaaattcgctttgaagtgtccatatatgattttaaagaatgtgacaaataaagatatccaatttcgaaatagtgctccggatacggtataggatatggtatagcaaataacatgctgatatggattgtccgatattaaattaagataatccaaatgttttaaaccgcataattcgatttttgagtcaaaagcgaatgccaattcagaaggttagcagttattgagtttcaaaatttatttggcgagcatatctagttctaaattctatcacgtaaattgtgtctttttttaataactacacaagactaaaagtttaaatctctctcaagatttgcgaaaactatagctatctactgatatatatatccgactatatttgttttcggaccgcatgcgtcctatttccgattcgaatctgcactccgatatatccacattgaatctaaaaccgatcaatatttgctccgatctaaatccggaaaaatatgtggtgaaggatatggtataagcaaaatccgatttgatccatttgtacctctaggcgtgtgcaagacctggaggaaagaatggcgcatctgtagggtgcagtcccaccggtggaaaatgtgagctcaccgtattgtcccccgatggagcatcgaaacggagtcggaacacgatttgcgccacgtacagagcatgcatgatttcccttgtatgcggtccaggatcttaaactgccttccatttccaggaacctaccgattggctgcaagccgtagctagcggtttgaagtcacggcattgccgcccccgattaacccacccgtcgcgcgcgcggtcggtcgtttcaccgtcctgcctaggctacgcacgcgcgcgcgcagttgggccagttgtaggtaagccgactcgagatcacacacccggcctcacctactacctctcgccgtcgcggtcaccgtgtcacactcacgcccaggggagccacccgcccacacggcgcctagctcatcccctctcactactcttcttctcctccctctcacctcgccgtcgacccagctcccggctctataaattccgcactactcgaaccaacatcgcccaggcctttgccttttacgacgaatcctaccaaaccgagctaccagatccttctctactaatcgagctccctacgctgctccgcctgtcttcgtttccgcctcaccgccggccggttctccgctccaagctacgtccgtccgtccacatatatagcatcgacatgaccatcgccgaggtcgtggctgccggagacaccgccgccgcggtggtgcagcccgccgggaacgggcagaccgtgtgcgtgaccggcgccgccgggtacatcgcgtcgtggctcgtcaagctgctgctggagaaggggtacaccgtcaagggcaccgtcaggaacccaggcatgtcacccatgcattcatcattttcttactagtcgtatgcgttatgcgacttgtgtattaactattgtggactgcatgcagacgacccgaagaacgcgcacctgagggcgctcgacggcgccgccgaccggctggtcctctgcaaggccgacctcctcgactacgacgccatccgccgcgccatcgacggctgccacggcgtcttccacaccgcgtcccccgtcaccgacgaccccgtacgtactccatagaactcggcacccctagcttctctccgttctctctgtatgtctgtcaccgtcgatcgccatggcagcacgcatgcatgcgcgcgcaacgctagctagacgctgaccgactcattgtgcaggagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccagggtgggtgctgcatgctcaatttttattatcatagctaccctttttctgcaccatgctgcatttcttttccaaaaacaactctcaaaagatatgctacgtggtgagttcctatagctgaattattacaactaccaccctatcgatcactaccgccctaaaagtgttcaacttttgaaggcaaccaaaaccaatacatgaacgacgatcgtgtgcgcttgtcgtcgttatcattagcctctgtagctctaattttcacctatgtacgcatggatagacgattcggaaatacagttcagtttacctaccatatactatgccgaaatcgaacgcacacaggtgtgaggcagcagccgctcacgagttatgcgccgaaaccgacatctcggaatcttcagtccacaatcaaaaaatagacacctggtaccactacaaaattatactcctactgtatattggtaaaacaaaacattttcttttttatttgataggagtgctgcaaattaaagttctttgtgtcatttttcaaaggaaaaaaaaaacacctttaccactcttcttccttgccatcattttttttttaccaaagtttgttctgtcaaatgaacatatatatagttcggtgctatgtcagtgccatttaccggccactagctagtaggactgccatgttccagcaaattgtctagtggaccggagtggccaaaaggagccaattatgtagggttgcaagcgggatcacacaaaagcctcgcctctagttcattttatcaattaagtggtactttctcagggaccccccttgcaactctaccattacatccgtgcaaaataaaagctagcatcacgcaccagatttagtactccctccgtttttatttagttcgcattctaggttcagccaaagtcatactttgcaaagtttaaccaaaattataagaaaaaaatatcaataatcatcatacaaaatacatataatataagagtaaaccttataacgattctacaatagatttttttattgcatatgtcaatattttttcataaatatttactcaaaattataaggtttgactttgactaaacccagaaccttcttagagaggaagaaatgcatgggcaaaagcaaatcatgcatatgggcaggagtaacatttttttgactttcatagaaagtactgtatggcactaaacggtctaaaccggacactggaagcaaatcgtgcacgtgggcaatattatctaccgtcgcgtcgccagtctccccatgcccatgaccatgcttggaattttagtctcgccggagctgccgagtgcatgcatagtgacgagtttcaataggccactatatatgtgatcatggctcttgatttgtcactttctttttttgccgaaggatatagtagtattactttctctgctatcacaaagaaagaactgattgtgtctagtctaggtggtctcagaattctgcatgactccagagtattcttgatgccacttgtttgttattgcaagaaacttaattcggagacaaccaaaagctcatcccatgtctctggaactagtagacataagaaaatctcatggtatcagtttgctatttatctacaactgaaacggcatgtttggttttattaaattcagaactggtactgctacgggaaggcggttgcggagcaggcggcatcggagttggcgcggcagcgcggcgtggaccttgtggtggtgaacccggtgctggtgatcggccccctgctgcagccgacggtgaacgccagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccaccaggtacgcgtacgacctgcttgctagccgcttccgttaattccattgccttaattgattgcatgatgccgctcctaatttactcacttgcgtaactaattgcattcatatatgatctaccaaccgtggagaaaattagcaagagtctgtcggggcgtcccggtccagtgcagttaacctgcatgtcgatggtctgcaggttgcagcttacttgtggttctttagttcagagacacagagcaattgggcactaagcaaaactgacatcactggtaattaggtagctcccacacactgaagtgggtggatcccatcggtagtaggtaagggtggatagtactggacgagagctcgatcgttgttgtaaaaaagcgagtgaccaccacttcaccatccactgcaagtagctgctagtgaaccatccaaccagctccctggatcactctgctccgtccgtaccttcagctacctacagaagcgacatgaacacacagacacacaaggccggctcaccattcgcataggtcaaaccaaatgttggtgaacggcaacatcgccacaagtcgcgtgctagttcgaggttgtgtccggtgtaccgaggccacactattcgtgctgcccgtcgctgatatttgcacgcgtagctgtcgacgaaagtaggtggactgacagatacacatatcctcattgccttctctgctcggtttctgctaggattgccatcttcaggagtgcctatccgcacggcagaaacgcgtagcatcaggccagaaagcagcgtgcgtgatatcgtaacccagacggtcttcacctgtccattctgggctacctggcatactacctcggtgccgctgtgccgctgaccaattcgtgcacgaccactatagcaaaaccctatgcatgtaactgcttcaagatcagcagtgacatgtgcaatataaacctcaagtgtgcactctagtgcgtactgataaaaccgtataactggtgacccagtcattcttctcttttttatttgtttggaccaaacgaacacagcatgttatccatcaccaacaagtggcgctgatttttcaaactacactgggatcatactggaaaccaaagcaggagaacatcttcgaaccaagagatgtttactaaatttgaaagaaaatgtactgacaagtaatctgtctgaagcaagacacatactacctcggttcgaacgtgggacaccatgcccgtgccatatttgctaggcaccactctgccgtcgattgtatcccaacggagggagtatcgatttgcgcaaagttcctacatacatagccgctcaagatataatcttacgaccttccgtcgaaatcggtgatacgtcgcaacctatagctaacttggcagagcataaaataactatctaaggttggggtctccctcttttcaatcaacctttcataccgaatgatgggagtgtttgtgaaaacatctcttggtcgactcagcattagcgccctaccaatttctctgtggacaatgccaccttaaatcgttttttagtcttcatgatttactcccccttatatctggccgtagtccctcttttccatttttcttgtctggttttaagtcaaatttagactactaaaacaacagcaagattttatggaagggaggtagtgcaaaacagaaagtccgatcgaaatgcgtgccaatttgtcgtcgcggcggccggactaaaatggatctgcatgtgcataccgttcgtcggagtatcctgcgaacggtcgtgtgtttagtcaacattaatgtgaggttcatgtgatactcttgcttgaaagatactactactgctacctcgtagaactgaatgaaagtatgtgggactgttcagctctctgcacatgtcaaatgtcgttactcatacctttcgtcagagcatcctgcgacgcgcgccggtgccgaaatttcgccgtgtgtttagtcaagatcaacgtgaggttcatgcggtaccctatctggcttcgaagataccaagcagactgcggctagattgtcattttgatgtcgcaatcttcaccaaacctgcccttccggaccacagcagcagtacgtaacaatggtgtcatcgccatgcgttgctcgtgtccaaggaaacggaggaatctcggcttcccacaagtcacgcatcgatgttcacacctgaattggtcgacgtttcttcttctagactagaaaaagattacagaacaacgcaagcttcgttcaagtccatacttctgttcagtatactcctgatgattgcagttatatcagcatgtctattctgaatttttgcacttctattcaaaggatgggctggaattgctactgactttggtgtgatgtgtgtggcacaggtgctctgatgagacgaacccgaggaagcagccatacaagatgtcgaaccagaagctccaggacctcggactcgagttcaggccggtgagccagtccctgtacgagacggtgaagagcctccaggagaagggccaccttccggtgctcagcgagcaggcagaggcggacaaggaaaccctagctgccgagctgcaggcaggggttaccatccgagcatgaggaacaagaaatcaaccatgtccatactgctactgtcatgtaaaccagctgttgaatgcctaaaatctaagttcttgtaatactgtgttgtttcatgtggactagattgatcg

SEQ ID NO: 19 - DNA, 15 bp, Artificial Sequence
  LpCCRI gene primer
atgaccatcgccgag

SEQ ID NO: 20 - DNA, 38 bp, Artificial Sequence
  LpCCRI gene primer
caagtttgtacaaaaaagcaggctatgaccatcgcgag

SEQ ID NO: 21 - DNA, 1934 bp, Festuca arundinacea
gggagcacggaatcccggccgccattcctccaccttcagctccggccaaagatttccatccggcgagatccatgggctccatcgcggcggacgcgccggaggcgcctcccgccgagctggtgttccggtccaagctcccggacatcgagatcccgacccacctgacgctgcaggactactgcttccagcgcctgccggagcactccgcgcgcgcctgcctcatcgacggcgccaccggcgccgcgctcacctacggcgaggtggacgcgctctcccgccgttgcgcggccggcctccgccgcctgggggtccgcaagggcgacgtcgtcatggcgctgctccgcaactgcccggagttcgccttcgtgttcctcggcgccgcccggctcggcgccgccaccaccaccgccaacccgttctacacgccccacgagatccaccgccaggccaccgccgccggcgccaaggtgatcgtcaccgaggcctgcgccgtcgagaaggtgcgcgcgttcgccgccgagagagggataaccgtcgtctccgtcgacgagggcgtcgacgacggctgcctcccgttcggcgagactctgctcggggaagacggcggcgagcggttcgtcgacgaggcggtcgacccggacgacgtggtggcgctgccgtactcgtccggcaccaccggcctccccaagggcgtcatgctcacccaccgcagcctcgtcaccagcgtcgcccagcaggtggacggtgagaacccgaatctgcacttcagctcgtcggacgtgctgctgtgcgtgctgccgctgttccacatctactctctcaactcggtgctgctggcggggctccgcgcgggttgcgcgatcgtgatcatgcgcaagttcgaccacggtgcgctggtggacctggtgcgcgcgcacggcgtcaccgtggcgccattcgtgccgcccatcgtggtggagatcgccaagagcgcgcgggtgacggcggcggacctggcgtccatccggctggtcatgtcgggggcggcgcccatgggcaaggagctgcaggacgcgttcatggccaagatccccaacgccgtgctcgggcagggatatgggatgaccgaggccggccccgtgctggccatgtgcctggccttcgccaaggagccgttcgaggtcaagtccggctcctgcggcaccgtcgtccggaacgccgagctcaagatcgtcgaccccgacaccggcgcctccctcggccgcaacctgcccggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccggcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggactccattccgaagagtccttctggtaagatccttaggaaggacctgagagcaaagctcgccgcaggcatccccggcagtgaaaccacacagtccaaaagctaagtcagatatattgtttcccaaccttacacacctctgtccaacatcatgtaatgttcttaatataaatggaaattaatacatatagaagggctgattctttttactagatgtccattgatatatttttagtccgatgatgtgtaccctgtcatgtatagataccgcctttattgaaaaaaaaaa

SEQ ID NO: 22 - protein, 559 aa, Festuca arundinacea
MGSIAADAPEAPPAELVFRSKLPDIEIPTHLTLQDYCFQRLPEHSARACLIDGATGAALTYGEVDALSRRCAAGLRRLGVRKGDVVMALLRNCPEFAFVFLGAARLGAATTTANPFYTPHEIHRQATAAGAKVIVTEACAVEKVRAFAAERGITVVSVDEGVDDGCLPFGETLLGEDGGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRAHGVTVAPFVPPIVVEIAKSARVTAADLASIRLVMSGAAPMGKELQDAFMAKIPNAVLGQGYGMTEAGPVLAMCLAFAKEPFEVKSGSCGTVVRNAELKIVDPDTGASLGRNLPGEICIRGKQIMKGYLNDPEATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPGSETTQSKS

SEQ ID NO: 23 - DNA, 1933 bp, Festuca arundinacea
gggagcacggaatcccggccgccattcctccaccttcagctccggccaaagatttccatccggcgagatccatggctccatcgcggcggacgcgccggaggcgcctcccgccgagctggtgttccggtccaagctcccggacatcgagatcccgacccacctgacgctgcaggactactgcttccagcgcctgccggagcactccgcgcgcgcctgcctcatcgacggcgccaccggcgccgcgctcacctacggcgaggtggacgcgctctcccgccgttgcgcggccggcctccgccgcctgggggtccgcaagggcgacgtcgtcatggcgctgctccgcaactgcccggagttcgccttcgtgttcctcggcgccgcccggctcggcgccgccaccaccaccgccaacccgttctacacgccccacgagatccaccgccaggccaccgccgccggcgccaaggtgatcgtcaccgaggcctgcgccgtcgagaaggtgcgcgcgttcgccgccgagagagggataaccgtcgtctccgtcgacgagggcgtcgacgacggctgcctcccgttcggcgagactctgctcggggaagacggcggcgagcggttcgtcgacgaggcggtcgacccggacgacgtggtggcgctgccgtactcgtccggcaccaccggcctccccaagggcgtcatgctcacccaccgcagcctcgtcaccagcgtcgcccagcaggtggacggtgagaacccgaatctgcacttcagctcgtcggacgtgctgctgtgcgtgctgccgctgttccacatctactctctcaactcggtgctgctggcggggctccgcgcgggttgcgcgatcgtgatcatgcgcaagttcgaccacggtgcgctggtggacctggtgcgcgcgcacggcgtcaccgtggcgccattcgtgccgcccatcgtggtggagatcgccaagagcgcgcgggtgacggcggcggacctggcgtccatccggctggtcatgtcgggggcggcgcccatgggcaaggagctgcaggacgcgttcatggccaagatccccaacgccgtgctcgggcagggatatgggatgaccgaggccggccccgtgctggccatgtgcctggccttcgccaaggagccgttcgaggtcaagtccggctcctgcggcaccgtcgtccggaacgccgagctcaagatcgtcgaccccgacaccggcgcctccctcggccgcaacctgcccggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccggcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggactccattccgaagagtccttctggtaagatccttaggaaggacctgagagcaaagctcgccgcaggcatccccggcagtgaaaccacacagtccaaaagctaagtcagatatattgtttcccaaccttacacacctctgtccaacatcatgtaatgttcttaatataaatggaaattaatacatatagaagggctgattctttttactagatgtccattgatatatttttagtccgatgatgtgtaccctgtcatgtatagataccgcctttattgaaaaaaaaaa

SEQ ID NO: 24 - protein, 604 aa, Festuca arundinacea
APSRRTRRRRLPPSWCSGPSSRTSRSRPTRCRTTASSACRSTPRAPASSTAPPAPRSPTARWTRSPAVARPASAAWGSARATSSWRCSATARSSPSCSSAPPGSAPPPPPPTRSTRPTRSTARPPPPAPRSSPRPAPSRRCARSPPREGPSSPSTRASTTAASRSARLCSGKTAASGSSTRRSTRTTWWRCRTRPAPPASPRASCSPTAASSPASPSRWTVRTRICTSARRTCCCACCRCSTSTLSTRCCWRGSARVARSSCASSTTVRWWTWCARTASPWRHSCRPSWWRSPRARGRRRTWRPSGWSCRGRRPWARSCRTRSWPRSPTPCSGRDMGPRPAPCWPCAWPSPRSRSRSSPAPAAPSSGTPSSRSSTPTPAPPSAATCPGRSASAASRSKVTMIRRPQRTPLTRTVGCILETLVMSMMTTRSLLSTDRRSNIRDSKYLRQNLKPFSLRTLKSRMLLSYRCKTNLLVKFRLRLLCGLKVQRSAKTRSSSSLQKRLFSTRGSAKCSSRTPFRRVLLVRSLGRTEQSSPQASPAVKPHSPKAKSDILFPNLTHLCPTSCNVLNINGNYIKGFFLLDVHYIFSPMMCTLSCIDTAFIEKK

SEQ ID NO: 25 - DNA, 2073 bp, Festuca arundinacea
gagcaagcgcgcgcacgcactcgcaccatctcccacgactaatttaaccaccttacaagaagatttccttagtctccgtttctctctcgatcgccggccggtgaggtagctagctagctactcgtagatcattaccatggggtctgtgccggaggagtcagtggtagccgcggccgtggcggagacggtgttccggtcgaagctccctgacatcgagatcaacaacgagcagacgctgcagagctactgcttcgagaagatggccgaggtcgcatcccgcccctgcatcatcgacgggcagacgggcgcctcctacacctacacagaggtggagtccctgacccgtcgcgccgcggcggggctccggcgcatgggcgtggggaagggcgacgtggtgatgaacctgctccgcaactgccccgagttcgccttctccttcctgggcgcggcgcggctcggcgccgccaccaccaccgccaacccgttctacaccccgcacgagatccaccgccaggcggaggcggcgggcgccaaggtgatcgtcacggaggcctgcgccgtggagaaggtgctggagttcgcggcggagcggggactgcccgtggtgaccgtcgacgggaagcgcgacgggtgcgtcgacttcgcggagctgatcgccggcgaggagctgcccgaggcggaggaggccgggatcctccccgacgacgtcgtggccctgccgtactcgtccggcaccaccgggctccccaagggcgtcatgctcacccaccgcagcctcgtcaccagcgtcgcccagctgtttgacgggtcgaacccgaacgtgtgcttcaacaaggacgacgcgctgctgtgcctgctgccgctcttccacatctactcgctgcacacggtgctgctggcggggctccgcgtcggggccgccatcgtcatcatgcgcaagttcgacgtcggcgcgctggtggacctcgtccgcgcgcaccgcatcaccatcgcgccattcgtgcccccgatcgtggtggagatcgccaagagcgaccgcgtcaccgccgacgacctcacatccatccgcatggtgctctccggcgccgcgcccatgggcaaggacctccaggacgcgttcatggccaagatccccaacgccgtgctcggacagggttacgggatgactgaggccggtccggtgctggccatgtgcctggcgttcgccaaggagcccttcaaggtcaagtccgggtcctgcggcaccgtggtgcgcaacgccgagctcaaggtcgtcgaccccgacaccggcgcatccctcggccggaaccagcctggcgagatctgcgtccgcgggaagcagatcatgataggttacctgaacgacccagagtcgaccaagaacaccatcgacaaggacggctggctgcacaccggagacatcggcttggtggatgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgacatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaggttgccgcgccaagaagctaagggccgctcctcaggaacgcagtcacccatggtgctgttatagaccacaccaaatggggaaagaaactacgggagggtacatgatcagattattcttgcaggagatatcagtttgttggttcgccctgcttgtgtaatgttgataaaatgaaatgatataatagatgtgttgttttatttttttgaccatgtaagaacaaggctgggattttactcccaaacaaacaaaaagaacaaggctgggatttttttcaaaaaaaaaa

SEQ ID NO: 26 - protein, 557 aa, Festuca arundinacea
MGSVPEESVVAAAVAETVFRSKLPDIEINNEQTLQSYCFEKMAEVASRPCIIDGQTGASYTYTEVESLTRRAAAGLRRMGVGKGDVVMNLLRNCPEFAFSFLGAARLGAATTTANPFYTPHEIHRQAEAAGAKVIVTEACAVEKVLEFAAERGLPVVTVDGKRDGCVDFAELIAGEELPEAEEAGILPDDVVALPYSSGTTGLPKGVMLTHRSLVTSVAQLFDGSNPNVCFNKDDALLCLLPLFHIYSLHTVLLAGLRVGAAIVIMRKFDVGALVDLVRAHRITIAPFVPPIVVEIAKSDRVTADDLTSIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEITENDIKQFVSKEVVFYKRINKVYFTDSIPKNPSGKILRKDLRARLAAGIPTEVAAPRS

SEQ ID NO: 27 - DNA, 2072 bp, Festuca arundinacea
gagcaagcgcgcgcacgcactcgcaccatctcccacgactaatttaaccaccttacaagaagatttccttagtctccgtttctctctcgatcgccggccggtgaggtagctagctagctactcgtagatcattaccatgggtctgtgccggaggagtcagtggtagccgcggccgtggcggagacggtgttccggtcgaagctccctgacatcgagatcaacaacgagcagacgctgcagagctactgcttcgagaagatggccgaggtcgcatcccgcccctgcatcatcgacgggcagacgggcgcctcctacacctacacagaggtggagtccctgacccgtcgcgccgcggcggggctccggcgcatgggcgtggggaagggcgacgtggtgatgaacctgctccgcaactgccccgagttcgccttctccttcctgggcgcggcgcggctcggcgccgccaccaccaccgccaacccgttctacaccccgcacgagatccaccgccaggcggaggcggcgggcgccaaggtgatcgtcacggaggcctgcgccgtggagaaggtgctggagttcgcggcggagcggggactgcccgtggtgaccgtcgacgggaagcgcgacgggtgcgtcgacttcgcggagctgatcgccggcgaggagctgcccgaggcggaggaggccgggatcctccccgacgacgtcgtggccctgccgtactcgtccggcaccaccgggctccccaagggcgtcatgctcacccaccgcagcctcgtcaccagcgtcgcccagctgtttgacgggtcgaacccgaacgtgtgcttcaacaaggacgacgcgctgctgtgcctgctgccgctcttccacatctactcgctgcacacggtgctgctggcggggctccgcgtcggggccgccatcgtcatcatgcgcaagttcgacgtcggcgcgctggtggacctcgtccgcgcgcaccgcatcaccatcgcgccattcgtgcccccgatcgtggtggagatcgccaagagcgaccgcgtcaccgccgacgacctcacatccatccgcatggtgctctccggcgccgcgcccatgggcaaggacctccaggacgcgttcatggccaagatccccaacgccgtgctcggacagggttacgggatgactgaggccggtccggtgctggccatgtgcctggcgttcgccaaggagcccttcaaggtcaagtccgggtcctgcggcaccgtggtgcgcaacgccgagctcaaggtcgtcgaccccgacaccggcgcatccctcggccggaaccagcctggcgagatctgcgtccgcgggaagcagatcatgataggttacctgaacgacccagagtcgaccaagaacaccatcgacaaggacggctggctgcacaccggagacatcggcttggtggatgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgacatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaggttgccgcgccaagaagctaagggccgctcctcaggaacgcagtcacccatggtgctgttatagaccacaccaaatggggaaagaaactacgggagggtacatgatcagattattcttgcaggagatatcagtttgttggttcgccctgcttgtgtaatgttgataaaatgaaatgatataatagatgtgttgttttatttttttgaccatgtaagaacaaggctgggattttactcccaaacaaacaaaaagaacaaggctgggatttttttcaaaaaaaaaa

SEQ ID NO: 28 - protein, 624 aa, Festuca arundinacea
MGLCRRSQWPRPWRRRCSGRSSLTSRSTTSRRCRATASRRWPRSHPAPASSTGRRAPPTPTQRWSPPVAPRRGSGAWAWGRATWTCSATAPSSPSPSWARRGSAPPPPPPTRSTPRTRSTARRRRRAPRSSRRPAPWRRCWSSRRSGDCPWPSTGSATGASTSRSSPARSCPRRRRPGSSPTTSWPCRTRPAPPGSPRASCSPTAASSPASPSCLTGRTRTCASTRTTRCCACCRSSTSTRCTRCCWRGSASGPPSSSCASSTSARWWTSSARTASPSRHSCPRSWWRSPRATASPPTTSHPSAWCSPAPRPWARTSRTRSWPRSPTPCSDRVTGLRPVRCWPCAWRSPRSPSRSSPGPAAPWCATPSSRSSTPTPAHPSAGTSLARSASAGSRSVTTTQSRPRTPSTRTAGCTPETSAWWMTTTRSSSSTGSRRSSSTRASRWRRRSSRPSSSRTRRSRTPPSGRMISAAKSRSPSLRGSKDLRSPRTTSSNSSQRRLFSTRGSTRSTSPTPFPRTLPARSGRTEPGSPLASPPRLPRQEAKGRSSGTQSPMVLLTTPNGERNYGRVHDQIILAGDISLLVRPACVMLIKNDIIDVLFYFFDHVRTRLGFYSQTNKKNKAGIF

SEQ ID NO: 29 - DNA, 1855 bp, Lolium perenne
ggatcttccggtccaggctcccggacatcgacatccctacccacatgcccctgcacgactactgcttcgcgacggcagcctcggccccggacgcgccgtgcctcattaccgcagccacggggcggacctacacgttcgccgagacgcacctgctctgccgcaaggccgcggcggcgctgcacgggctcggcgtgcgccacggggaccggatcatggtgctgctgcagaactccgtggagttcgcgctcgccttcttcggcgcgtccatgctcggggccgtcagcacggcggcgaacccgttctgcacgccgcaggagatccacaagcagctcgtggcctccggcgcgaagctggtcgtcacgcagtccgcctacgtcgacaagctccggcacgaggccttcccacgaatcggcgaggccctgaccgtgatcaccatcgacgacgacggcaccccggacggctgccagccgttctggggcctcgtgtcagccgccgacgagaacagcgtcccggagtctcccatctcgccggacgacgcggtggcgctgccctactcgtcgggcacgacggggctgcccaagggcgtggtgctgacgcacgggggcctggtgtcgagcgtggcgcagcaggtggacggcgagaacccgaacctgcacatgcgggcgggggaggacgtggtgctctgcgtgctgccgctcttccacatcttctcgctcaactcggtgctgctgtgcgcgctgcgggcgggcgccgccgtgatgctgatgcctaggttcgagatgggggccatgctggagggcatcgagcggtggcgcgtcacggtggcggccgtggtgccgccgctggtgctcgcgctcgccaagaaccccggggtggagaagcacgacctcagctccattcggatcgtgctctccggcgccgcgccgctcggcaaggagctcgaggacgcgctacgtggccgcctgccgcaggccatcttcggacagggctacgggatgacggaggccgggccggtgctgtccatgtgcccggcgttcgcgcgggagccgacgccggccaagtccggctcctgcggcacggtggtgcgcaacgccgagctcaaggtggtcgaccccgacaccggcgtctccctcggccgcaacctccccggcgagatctgcatccgcggcccgcagatcatgaaaggatacttgaatgatcccgtggccaccgccgcgaccatcgacgtcgagggatggctccacaccggcgacatcggctacgtcgacgacgacgacgaggtcttcatcgtcgaccgcgtcaaggagctcatcaagttcaagggcttccaggtaccgccggccgagctcgaggctctgctcatcgcgcacccgtccatcgccgacgcggccgtcgtcccgcaaaaggatgatgccgccggcgaggtcccggtcgccttcgtggtccgcgccgccgactccgacatcgccgaggaggccatcaaggagttcgtatccaagcaggtggtgttctacaagaggctgcacaaggtctacttcacccacgcgatccccaagtcggcgtcggggaagatactcaggaaagaactcagagctaaactcgccgccccggccactgcctgaagagtggttcaaggcttcatgctaatcatttcgatcagaaaggcagttcctatgttccaccttttgtttcatttggaagattgtattccagctagtggccagtgactgagtaagggatggggataaaagttttgtctacgttttcttttacgctactctctccattgaggagtacaatgtatcaggggattcgtgattgaaattaatcaagattggttcaattaaaaaaaaaa

SEQ ID NO: 30 - protein, 539 aa, Lolium perenne
IFRSRLPDIDIPTHMPLHDYCFATAASAPDAPCLITAATGRTYTFAETHLLCRKAAAALHGLGVRHGDRIMVLLQNSVEFALAFFGASMLGAVSTAANPFCTPQEIHKQLVASGAKLVVTQSAYVDKLRHEAFPRIGEALTVITIDDDGTPDGCQPFWGLVSAADENSVPESPISPDDAVALPYSSGTTGLPKGVVLTHGGLVSSVAQQVDGENPNLHMRAGEDVVLCVLPLFHIFSLNSVLLCALRAGAAVMLMPRFEMGAMLEGIERWRVTVAAVVPPLVLALAKNPGVEKHDLSSIRIVLSGAAPLGKELEDALRGRLPQAIFGQGYGMTEAGPVLSMCPAFAREPTPAKSGSCGTVVRNAELKVVDPDTGVSLGRNLPGEICIRGPQIMKGYLNDPVATAATIDVEGWLHTGDIGYVDDDDEVFIVDRVKELIKFKGFQVPPAELEALLIAHPSIADAAVVPQKDDAAGEVPVAFVVRAADSDIAEEAIKEFVSKQVVFYKRLHKVYFTHAIPKSASGKILRKELRAKLAAPATA

SEQ ID NO: 31 - DNA, 1854 bp, Lolium perenne
ggatcttccggtccaggctcccggacatcgacatccctacccacatgccctgcacgactactgcttcgcgacggcagcctcggccccggacgcgccgtgcctcattaccgcagccacggggcggacctacacgttcgccgagacgcacctgctctgccgcaaggccgcggcggcgctgcacgggctcggcgtgcgccacggggaccggatcatggtgctgctgcagaactccgtggagttcgcgctcgccttcttcggcgcgtccatgctcggggccgtcagcacggcggcgaacccgttctgcacgccgcaggagatccacaagcagctcgtggcctccggcgcgaagctggtcgtcacgcagtccgcctacgtcgacaagctccggcacgaggccttcccacgaatcggcgaggccctgaccgtgatcaccatcgacgacgacggcaccccggacggctgccagccgttctggggcctcgtgtcagccgccgacgagaacagcgtcccggagtctcccatctcgccggacgacgcggtggcgctgccctactcgtcgggcacgacggggctgcccaagggcgtggtgctgacgcacgggggcctggtgtcgagcgtggcgcagcaggtggacggcgagaacccgaacctgcacatgcgggcgggggaggacgtggtgctctgcgtgctgccgctcttccacatcttctcgctcaactcggtgctgctgtgcgcgctgcgggcgggcgccgccgtgatgctgatgcctaggttcgagatgggggccatgctggagggcatcgagcggtggcgcgtcacggtggcggccgtggtgccgccgctggtgctcgcgctcgccaagaaccccggggtggagaagcacgacctcagctccattcggatcgtgctctccggcgccgcgccgctcggcaaggagctcgaggacgcgctacgtggccgcctgccgcaggccatcttcggacagggctacgggatgacggaggccgggccggtgctgtccatgtgcccggcgttcgcgcgggagccgacgccggccaagtccggctcctgcggcacggtggtgcgcaacgccgagctcaaggtggtcgaccccgacaccggcgtctccctcggccgcaacctccccggcgagatctgcatccgcggcccgcagatcatgaaaggatacttgaatgatcccgtggccaccgccgcgaccatcgacgtcgagggatggctccacaccggcgacatcggctacgtcgacgacgacgacgaggtcttcatcgtcgaccgcgtcaaggagctcatcaagttcaagggcttccaggtaccgccggccgagctcgaggctctgctcatcgcgcacccgtccatcgccgacgcggccgtcgtcccgcaaaaggatgatgccgccggcgaggtcccggtcgccttcgtggtccgcgccgccgactccgacatcgccgaggaggccatcaaggagttcgtatccaagcaggtggtgttctacaagaggctgcacaaggtctacttcacccacgcgatccccaagtcggcgtcggggaagatactcaggaaagaactcagagctaaactcgccgccccggccactgcctgaagagtggttcaaggcttcatgctaatcatttcgatcagaaaggcagttcctatgttccaccttttgtttcatttggaagattgtattccagctagtggccagtgactgagtaagggatggggataaaagttttgtctacgttttcttttacgctactctctccattgaggagtacaatgtatcaggggattcgtgattgaaattaatcaagattggttcaattaaaaaaaaaa

SEQ ID NO: 32 - protein, 518 aa, Lolium perenne
MPCTTTASRRQPRPRTRRASLPQPRGGPTRSPRRTCSAARPRRRCTGSACATGTGSWCCCRTPWSSRSPSSARPCSGPSARRRTRSARRRRSTSSSWPPARSWSSRSPPTSTSSGTRPSHESARPPSPSTTTAPRTAASRSGASCQPPTRTASRSLPSRRTTRWRCPTRRARRGCPRAWCRTGAWCRAWRSRWTARTRTCTCGRGRTWCSACCRSSTSSRSTRCCCARCGRAPPCCLGSRWGPCWRASSGGASRWRPWCRRWCSRSPRTPGWRSTTSAPFGSCSPAPRRSARSSRTRYVAACRRPSSDRATGRRPGRCCPCARRSRGSRRRPSPAPAARWCATPSSRWSTPTPASPSAATSPARSASAARRSKDTMIPWPPPRPSTSRDGSTPATSATSTTTTRSSSSTASRSSSSSRASRYRRPSSRLCSSRTRPSPTRPSSRKRMMPPARSRSPSWSAPPTPTSPRRPSRSSYPSRWCSTRGCTRSTSPTRSPSRRRGRYSGKNSELNSPPRPLPE

SEQ ID NO: 33 - DNA, 2039 bp, Lolium perenne
aggaggtggtggaggagcacgaaatcccggccgccattcctccaccttccgctccgaccaaagatttccatccggcgagatccatgggctccatcgcggcagacttggcgccggaggcgcccgcggagctggtgttccggtcgaagctcccggacatcgagatcccgacccacctgacgctgcaagactactgcttcgagcgcctgccggagctctccgcccgcgcctgcctcatcgacggcgccacgggcgccgcgctcacctacggcgaggtggacgccctctcgcgccgctgcgcggccgggctgcgccgcctcggcgtccgcaagggcgacgtggtcatggcgctcctccgcaactgccccgagttcgccttcgtgttcctcggcgcggcccggctcggcgccgccaccaccaccgccaacccgttctacacgccccacgagatccaccgccaggccgccgcggccggcgccaaggtgatcgtcaccgaggcctgcgccgtcgagaaggtgcgcgccttcgccgccgagagagggatccccgtcgtctccgtcgacgaggccgtcgacgacggctgcctcccgttcgccgcgactctcctcggggaagaaagcggcgagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtccgacgtgctgctgtgcgtgctgccgctgttccacatctactcgctcaactcggtgctgctcgccggtttacgcgccgggtgcgcgatcgtgatcatgcgcaagttcgaccacggcgctttggtggacctggtgcgcgcgcacggcgtcacggtggcgccattcgtgccgcccatcgtggtggagatcgccaagagcgcgcgggtgaccgccgcggacctggcgtcgatccggctggtcatgtcgggggcggcgcccatgggcaaggagctgcaggacgcgttcatggccaagatccccaacgctgtgctcgggcagggatatgggatgaccgaggccggccccgtgctagccatgtgcctggccttcgccaaggagccgttcgaggtcaagtctggctcctgcggcaccgtcgtccggaacgccgagctcaagatcgtcgaccccgacaccggcgcctccctcggccgcaacctgccgggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccagcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccggcagtgataccacacagtccaaaaactaagtcagatatattgtttcccaaccttacacacctctgtccaacaccatgtaatgttcttaatataaacggaaattattacatatagaagggctgattctttttactagatgtgtccaacatatgatatgtttgttaggccgatgatgtgtaacctgtcatgtatagataccgcctttttttgataagaaaggctgattataatgtataccatgagctgaatatttgttcaaggagatcaggattcggttgccaattgtttaccttttaaaaaaaaaa

SEQ ID NO: 34 - protein, 559 aa, Lolium perenne
MGSIAADLAPEAPAELVFRSKLPDIEIPTHLTLQDYCFERLPELSARACLIDGATGAALTYGEVDALSRRCAAGLRRLGVRKGDVVMALLRNCPEFAFVFLGAARLGAATTTANPFYTPHEIHRQAAAAGAKVIVTEACAVEKVRAFAAERGIPVVSVDEAVDDGCLPFAATLLGEESGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRAHGVTVAPFVPPIVVEIAKSARVTAADLASIRLVMSGAAPMGKELQDAFMAKIPNAVLGQGYGMTEAGPVLAMCLAFAKEPFEVKSGSCGTVVRNAELKIVDPDTGASLGRNLPGEICIRGKQIMKGYLNDPEATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPGSDTTQSKN

SEQ ID NO: 35 - DNA, 2038 bp, Lolium perenne
aggaggtggtggaggagcacgaaatcccggccgccattcctccaccttccgctccgaccaaagatttccatccggcgagatccatggctccatcgcggcagacttggcgccggaggcgcccgcggagctggtgttccggtcgaagctcccggacatcgagatcccgacccacctgacgctgcaagactactgcttcgagcgcctgccggagctctccgcccgcgcctgcctcatcgacggcgccacgggcgccgcgctcacctacggcgaggtggacgccctctcgcgccgctgcgcggccgggctgcgccgcctcggcgtccgcaagggcgacgtggtcatggcgctcctccgcaactgccccgagttcgccttcgtgttcctcggcgcggcccggctcggcgccgccaccaccaccgccaacccgttctacacgccccacgagatccaccgccaggccgccgcggccggcgccaaggtgatcgtcaccgaggcctgcgccgtcgagaaggtgcgcgccttcgccgccgagagagggatccccgtcgtctccgtcgacgaggccgtcgacgacggctgcctcccgttcgccgcgactctcctcggggaagaaagcggcgagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtccgacgtgctgctgtgcgtgctgccgctgttccacatctactcgctcaactcggtgctgctcgccggtttacgcgccgggtgcgcgatcgtgatcatgcgcaagttcgaccacggcgctttggtggacctggtgcgcgcgcacggcgtcacggtggcgccattcgtgccgcccatcgtggtggagatcgccaagagcgcgcgggtgaccgccgcggacctggcgtcgatccggctggtcatgtcgggggcggcgcccatgggcaaggagctgcaggacgcgttcatggccaagatccccaacgctgtgctcgggcagggatatgggatgaccgaggccggccccgtgctagccatgtgcctggccttcgccaaggagccgttcgaggtcaagtctggctcctgcggcaccgtcgtccggaacgccgagctcaagatcgtcgaccccgacaccggcgcctccctcggccgcaacctgccgggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccagcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccggcagtgataccacacagtccaaaaactaagtcagatatattgtttcccaaccttacacacctctgtccaacaccatgtaatgttcttaatataaacggaaattattacatatagaagggctgattctttttactagatgtgtccaacatatgatatgtttgttaggccgatgatgtgtaacctgtcatgtatagataccgcctttttttgataagaaaggctgattataatgtataccatgagctgaatatttgttcaaggagatcaggattcggttgccaattgtttaccttttaaaaaaaaaa

SEQ ID NO: 36 - protein, 548 aa, Lolium perenne
MAPSRQTWRRRRPRSWCSGRSSRTSRSRPTRCKTTASSACRSSPPAPASSTAPRAPRSPTARWTPSRAAARPGCAASASARATWSWRSSATAPSSPSCSSARPGSAPPPPPPTRSTRPTRSTARPPRPAPRSSPRPAPSRRCAPSPPREGSPSSPSTRPSTTAASRSPRLSSGKKAASGSSTRRSTPTTWWRCRTRPAPPACPRASCSPTAASSPASPSRWTVRTRTCTSARPTCCCACCRCSTSTRSTRCCSPVYAPGARSSCASSTTALWWTWCARTASRWRHSCRPSWWRSPRARGPPRTWRRSGWSCRGRRPWARSCRTRSWPRSPTLCSGRDMGPRPAPCPCAWPSPRSRSRSSLAPAAPSSGTPSSRSSTPTPAPPSAATCRGRSASAASRSKVTMIRRPQRTPLTRTVGCILETLVMSMMTTRSLLSTDRRSNIRDSKYLQQNLKPFSLRTLKSRMLLSYRCKTNLLVKFRLRLLCGLKVQRSAKTRSSSSLQKRLFSTRGSAKCSSRIPFQRVHLARSSGRTEQSSPQAFPAVIPHSPKT

SEQ ID NO: 37 - DNA, 2006 bp, Lolium perenne
gagagaggagatcaagcaagccatctcccacgactaatttagaagaagatttacttagtctctgcttctcgctcgatcgccggccggtgaggtagctagctagctactcgtactagatcattaccatgggttccgtgccggaggagtcagtggtgtccgtggccgcggcggagacggtgttccggtcgaagctccccgacatcgagatcaacaacgagcagacgctgcagagctactgcttcgagaagatggccgaggtcgcgtcccgcccctgcatcatcgacggccagacgggcgcctcctacacctacacggaggtcgactccctgacccgtcgcgccgcggcggggctgcgccgcatgggcgtggggaagggcgacgtggtgatgaacctgctccgcaactgccccgagttcgccttctccttcctgggcgcggccaggctgggcgccgccaccaccaccgccaacccgttctacaccccgcacgagatccaccgccaggcggaggcggcgggcgccaagctgatcgtcaccgaggcctgcgccgtggagaaggtgctggagttcgcggcggggcggggcctgcccgtggtcaccgtcgacgggaggcgcgacgggtgcgtggacttcgcggagctgatcgccggcgaggagctgcccgaggcggacgaggccgggatcctccccgacgacgtcgtcgccctgccctactcctccggcaccaccgggctccccaagggcgtcatgctcacccaccgcagcctcgtcaccagcgtcgcccagctggttgacgggtcgaacccaaacgtgtgcttcaacaaggacgacgcgctgctgtgcctgctgccgctgttccacatctactcgctgcacacggtgctgctggcggggctccgcgtcggcgccgccatcgtcatcatgcgcaagttcgacgtcggcgcgctggtggacctcgtccgcgcgcaccgcatcaccatcgcgccattcgtgccgcccatcgtcgtggagatcgccaagagcgaccgcgtcggcgccgacgacctcgcatccatccgcatggtgctctccggcgccgcgcccatgggcaaggacctccaggacgccttcatggccaagatccccaacgccgtgctcggacagggttacgggatgactgaggccgggccggtgctggccatgtgcctggcgttcgccaaggagcccttcaaggtcaagtccgggtcgtgcggcaccgtggtgcgcaacgcagagctcaaggtcgtcgaccccgacaccggcgcatccctcggcaggaaccagcccggcgagatctgcgtccgcgggaagcagatcatgataggttacctgaacgacccagagtctaccaagaacaccatcgacaaggacggctggctgcacaccggagatatcggcttggtggacgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgagatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaagttgccgcgccgagaagctaagggccgcttctcaggaacgcaatcacccatggtgctgtttaggtgctgttatagaccacaccaaatggggaaagaaactacgggaggggatcatattattcttgcaggagatatcagtttgttgattcgccctgcttgtgtaatgttgataaaatgaaatgatataatagatgtgttgttttattttttgaccatgtaaaaaaaaaa

SEQ ID NO: 38 - protein, 557 aa, Lolium perenne
MGSVPEESVVSVAAAETVFRSKLPDIEINNEQTLQSYCFEKMAEVASRPCIIDGQTGASYTYTEVDSLTRRAAAGLRRMGVGKGDVVMNLLRNCPEFAFSFLGAARLGAATTTANPFYTPHEIHRQAEAAGAKLIVTEACAVEKVLEFAAGRGLPVVTVDGRRDGCVDFAELIAGEELPEADEAGILPDDVVALPYSSGTTGLPKGVMLTHRSLVTSVAQLVDGSNPNVCFNKDDALLCLLPLFHIYSLHTVLLAGLRVGAAIVIMRKFDVGALVDLVRAHRITIAPFVPPIVVEIAKSDRVGADDLASIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEITENEIKQFVSKEVVFYKRINKVYFTDSIPKNPSGKILRKDLRARLAAGIPTEVAAPRS

SEQ ID NO: 39 - DNA, 2005 bp, Lolium perenne
gagagaggagatcaagcaagccatctcccacgactaatttagaagaagatttacttagtctctgcttctcgctcgatcgccggccggtgaggtagctagctagctactcgtactagatcattaccatggttccgtgccggaggagtcagtggtgtccgtggccgcggcggagacggtgttccggtcgaagctccccgacatcgagatcaacaacgagcagacgctgcagagctactgcttcgagaagatggccgaggtcgcgtcccgcccctgcatcatcgacggccagacgggcgcctcctacacctacacggaggtcgactccctgacccgtcgcgccgcggcggggctgcgccgcatgggcgtggggaagggcgacgtggtgatgaacctgctccgcaactgccccgagttcgccttctccttcctgggcgcggccaggctgggcgccgccaccaccaccgccaacccgttctacaccccgcacgagatccaccgccaggcggaggcggcgggcgccaagctgatcgtcaccgaggcctgcgccgtggagaaggtgctggagttcgcggcggggcggggcctgcccgtggtcaccgtcgacgggaggcgcgacgggtgcgtggacttcgcggagctgatcgccggcgaggagctgcccgaggcggacgaggccgggatcctccccgacgacgtcgtcgccctgccctactcctccggcaccaccgggctccccaagggcgtcatgctcacccaccgcagcctcgtcaccagcgtcgcccagctggttgacgggtcgaacccaaacgtgtgcttcaacaaggacgacgcgctgctgtgcctgctgccgctgttccacatctactcgctgcacacggtgctgctggcggggctccgcgtcggcgccgccatcgtcatcatgcgcaagttcgacgtcggcgcgctggtggacctcgtccgcgcgcaccgcatcaccatcgcgccattcgtgccgcccatcgtcgtggagatcgccaagagcgaccgcgtcggcgccgacgacctcgcatccatccgcatggtgctctccggcgccgcgcccatgggcaaggacctccaggacgccttcatggccaagatccccaacgccgtgctcggacagggttacgggatgactgaggccgggccggtgctggccatgtgcctggcgttcgccaaggagcccttcaaggtcaagtccgggtcgtgcggcaccgtggtgcgcaacgcagagctcaaggtcgtcgaccccgacaccggcgcatccctcggcaggaaccagcccggcgagatctgcgtccgcgggaagcagatcatgataggttacctgaacgacccagagtctaccaagaacaccatcgacaaggacggctggctgcacaccggagatatcggcttggtggacgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgagatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaagttgccgcgccgagaagctaagggccgcttctcaggaacgcaatcacccatggtgctgtttaggtgctgttatagaccacaccaaatggggaaagaaactacgggaggggatcatattattcttgcaggagatatcagtttgttgattcgccctgcttgtgtaatgttgataaaatgaaatgatataatagatgtgttgttttattttttgaccatgtaaaaaaaaaa

SEQ ID NO: 40 - protein, 548 aa, Lolium perenne; identical to SEQ ID NO: 36

SEQ ID NO: 41 - DNA, 1775 bp, Festuca arundinacea
gcaacaaccgttactgagcgcgcgaaaacgcacgagagagagagtgaagcggcgcgtgtattcttcactggccgtcgccatggatttcgtcttcgtggagaagctcctcgtcgggctcctagcgtccgtggtggtcgcgatcgtcgtgtccaagatccgcggccgcaaactgaggctgccgccgggccccatccccgtgcccatcttcggcaactggctgcaggtcggggacgacctgaaccaccgcaacctggcggcgatggcccgcaagttcggggaggtgttcctcctccgcatgggcatccgcaacctggtggtggtgtcgagcccggagctggccaaggaggtgctccacacgcagggcgtggagttcgggtcccgcacacgcaacgtcgtcttcgacatcttcaccggcaaggggcaggacatggtgttcacggtgtacggcgaccactggcgcaagatgcggcggatcatgacggtgcccttcttcacgaacaaggtggtgcagcagtaccgggccgggtgggaggcggaggcggccttcgttgtggacaacgtgcgcgccgaccccaaggccgccaccgacggcgtggtgctccgccgccacctgcagctgatgatgtacaacaacatgtaccgcatcatgttcgaccggcggttcgagagcatggacgacccgctcttcctccgcctcagggcgctcaacggcgagcgcagccgcctggcgcagagcttcgagtacaactacggcgacttcatccccgttctccgccccttcctccgcggctacctcgggctctgcgaacaggtcaaggagacccgcctcaagctcttcaaggattacttcctggacgagaggaagaagctggcgagcacaaagtccatggacaccaacggcctcaagtgcgccattgatcacatcctggaggcgcaggagaagggagagatcaacgaggacaacgtcctctacatcatcgagaacatcaacgtcgccgcgatcgagacgacgctgtggtcgatcgagtgggggatcgcggagctggtgaaccacccggagatccagcagaagctgcgcgacgagatggacgcggtgctgggcgccggccaccagatcacggagcccgacacgcacaagctcccctacctgcaagccgtgatcaaggagacgctgcggctgcgcatggctatcccgctgctggtgccgcacatgaaccttcacgacgccaagctcgccggctacaacatccccgccgagagcaagatcctcgtcaacgcctggttcctcgccaacaacccggagcagtggaagaggcccgacgagttccgccccgagcgcttcctggaggaggagaagcacgtcgaggccagcggcaacgacttcaggttcctgcccttcggcgtcggccgccggagctgcccggggatcatcctcgcgctgcccatcctcggcatcaccatcggccgcctcgtgcagaacttcgagctcaccacgccgccgggggtggacaagctcgacaccaccgagaagggtggccagttcagcctccacatcttgaaccactccaccatcgtcgccaagcccagagtgttctgagttctgagttgcgtgcagcttctggtttgatgctgtactctcttgcgtgcatgtttgctcgtcctaaaaccttaattatgtatgtctactacagagtagatacaagtttcgtatgttatctgcaagaaacagaggatatatatgaacttttttaaaaaacagtaaaaaaaaaaaaaaa

SEQ ID NO: 42 - protein, 505 aa, Festuca arundinacea
MDFVFVEKLLVGLLASVVVAIVVSKIRGRKLRLPPGPIPVPIFGNWLQVGDDLNHRNLAAMARKFGEVFLLRMGIRNLVVVSSPELAKEVLHTQGVEFGSRTRNVVFDIFTGKGQDMVFTVYGDHWRKMRRIMTVPFFTNKVVQQYRAGWEAEAAFVVDNVRADPKAATDGVVLRRHLQLMMYNNMYRIMFDRRFESMDDPLFLRLRALNGERSRLAQSFEYNYGDFIPVLRPFLRGYLGLCEQVKETRLKLFKDYFLDERKKLASTKSMDTNGLKCAIDHILEAQEKGEINEDNVLYIIENINVAAIETTLWSIEWGIAELVNHPEIQQKLRDEMDAVLGAGHQITEPDTHKLPYLQAVIKETLRLRMAIPLLVPHMNLHDAKLAGYNIPAESKILVNAWFLANNPEQWKRPDEFRPERFLEEEKHVEASGNDFRFLPFGVGRRSCPGIILALPILGITIGRLVQNFELTTPPGVDKLDTTEKGGQFSLHILNHSTIVAKPRVF

SEQ ID NO: 43 - DNA, 1774 bp, Festuca arundinacea
gcaacaaccgttactgagcgcgcgaaaacgcacgagagagagagtgaagcggcgcgtgtattcttcactggccgtcgccatgatttcgtcttcgtggagaagctcctcgtcgggctcctagcgtccgtggtggtcgcgatcgtcgtgtccaagatccgcggccgcaaactgaggctgccgccgggccccatccccgtgcccatcttcggcaactggctgcaggtcggggacgacctgaaccaccgcaacctggcggcgatggcccgcaagttcggggaggtgttcctcctccgcatgggcatccgcaacctggtggtggtgtcgagcccggagctggccaaggaggtgctccacacgcagggcgtggagttcgggtcccgcacacgcaacgtcgtcttcgacatcttcaccggcaaggggcaggacatggtgttcacggtgtacggcgaccactggcgcaagatgcggcggatcatgacggtgcccttcttcacgaacaaggtggtgcagcagtaccgggccgggtgggaggcggaggcggccttcgttgtggacaacgtgcgcgccgaccccaaggccgccaccgacggcgtggtgctccgccgccacctgcagctgatgatgtacaacaacatgtaccgcatcatgttcgaccggcggttcgagagcatggacgacccgctcttcctccgcctcagggcgctcaacggcgagcgcagccgcctggcgcagagcttcgagtacaactacggcgacttcatccccgttctccgccccttcctccgcggctacctcgggctctgcgaacaggtcaaggagacccgcctcaagctcttcaaggattacttcctggacgagaggaagaagctggcgagcacaaagtccatggacaccaacggcctcaagtgcgccattgatcacatcctggaggcgcaggagaagggagagatcaacgaggacaacgtcctctacatcatcgagaacatcaacgtcgccgcgatcgagacgacgctgtggtcgatcgagtgggggatcgcggagctggtgaaccacccggagatccagcagaagctgcgcgacgagatggacgcggtgctgggcgccggccaccagatcacggagcccgacacgcacaagctcccctacctgcaagccgtgatcaaggagacgctgcggctgcgcatggctatcccgctgctggtgccgcacatgaaccttcacgacgccaagctcgccggctacaacatccccgccgagagcaagatcctcgtcaacgcctggttcctcgccaacaacccggagcagtggaagaggcccgacgagttccgccccgagcgcttcctggaggaggagaagcacgtcgaggccagcggcaacgacttcaggttcctgcccttcggcgtcggccgccggagctgcccggggatcatcctcgcgctgcccatcctcggcatcaccatcggccgcctcgtgcagaacttcgagctcaccacgccgccgggggtggacaagctcgacaccaccgagaagggtggccagttcagcctccacatcttgaaccactccaccatcgtcgccaagcccagagtgttctgagttctgagttgcgtgcagcttctggtttgatgctgtactctcttgcgtgcatgtttgctcgtcctaaaaccttaattatgtatgtctactacagagtagatacaagtttcgtatgttatctgcaagaaacagaggatatatatgaacttttttaaaaaacagtaaaaaaaaaaaaaaa

SEQ ID NO: 44 - protein, 495 aa, Festuca arundinacea
MISSSWRSSSSGSRPWWSRSSCPRSAAANGCRRAPSPCPSSATGCRSGTTTTATWRRWPASSGRCSSSAWASATWWWCRARSWPRRCSTRRAWSSGPAHATSSSTSSPARGRTWCSRCTATTGARCGGSRCPSSRTRWCSSTGPGGRRRRPSLWTTCAPTPRPPPTAWCSAATCSCTTTCTASCSTGGSRAWTTRSSSASGRSTASAAAWRRASSTTTATSSPFSAPSSAATSGSANRSRRPASSSSRITSWTRGRSWRAQSPWTPTASSAPLITSWRRRRRERSTRTTSSTSSRTSTSPRSRRRCGRSSGGSRSWTTRRSSRSCATRWTRCWAPATRSRSPTRTSSPTCKPSRRRCGCAWLSRCWCRTTFTTPSSPATTSPPRARSSSTPGSSPTTRSSGRGPTSSAPSASWRRRSTSRPAATTSGSCPSASAAGAARGSSSRCPSSASPSAASCRTSSSPRRRGWTSSTPPRRVASSASTSTTPPSSPSPECS

SEQ ID NO: 45 - DNA, 1789 bp, Lolium perenne
ctcaacactcgccaatcccacagccacagaagccacctaccaccgctccaccgatcgacgatggaggtcctcctcctggagaaggccctactggggctcttcgcggcggcggtgctggccatcgccgtcgcgaagctcgccggcaagcgcttccgcctcccgcccggcccctccggcgcccccatcgtcggcaactggctccaggtcggcgacgacctgaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgggtgggctgggaggaggaggccaggctcgtggtggaggacgtcaaggccgacccggcgtccgcgaccgccggcaccgtgatccgccgtaggctgcagctcatgatgtacaacgacatgttccgcatcatgttcgaccgcaggttcgagtccgtcgacgacccgctcttcaacaagctcaaggccatgaacgccgagcgcagcatcctgtcgcagagcttcgactacaactacggcgacttcatccccattctccgaccgttcctccgcaagtacctcaaccggtgcacaaacctcaagaccaagaggatgaagctcttcgaggaccacttcgtcgctgacagaaagaaggcgctggagcagaatggggagatcaggtgcgccatggaccacatcctggaggcggagaggaagggcgagatcaaccacgacaacgtcctctacatcgtcgagaacatcaacgttgcagccatcgagacaacgctgtggtcgatcgagtggggcatcgcggagctggtgaaccacccggacgtccagtcgaagctccgcgacgagatgaccgccgtgctgggcgccgacgtggcggtgacggagccggacctggagcgcctcccctacctgcagtccgtcgtgaaggagaccctccgcctccgcatggccatcccgctgctcgtgccgcacatgaatctcagcgacgccaagctcgccggctacgacatccccgccgagtccaagatcctcgtcaacgcatggttcctcgccaacgaccccaagcggtgggtgcgcgccgacgagttcaggcccgagcgcttcctcgaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgataccaccgagaagcccggacagttcagcaaccagatcctcaagcacgccaccgtcgtctgcaagccgctcgaggcctagaattttctatttgatcgtatggaggcttctgacatgcgtgtctgtgcatgcatgcgtgaacgctggtgccgggagatcgatctatgcacgcatgtgatgtgtattttcctttttttgtgcttttattttacttagttgcatttttgttggtcttcatgtgaggcgtcatgttgtagatttactatgttggtgataatgatgtaaaacttcttcaaaaaaaaaa

SEQ ID NO: 46 - protein, 501 aa, Lolium perenne
MEVLLLEKALLGLFAAAVLAIAVAKLAGKRFRLPPGPSGAPIVGNWLQVGDDLNHRNLMGIAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATAGTVIRRRLQLMMYNDMFRIMFDRRFESVDDPLFNKLKAMNAERSILSQSFDYNYGDFIPILRPFLRKYLNRCTNLKTKRMKLFEDHFVADRKKALEQNGEIRCAMDHILEAERKGEINHDNVLYIVENINVAAIETTLWSIEWGIAELVNHPDVQSKLRDEMTAVLGADVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIVLALPIIGITLGRLVQNFQLLPPPGQDKIDTTEKPGQFSNQILKHATVVCKPLEA

SEQ ID NO: 47 - DNA, 1788 bp, Lolium perenne
ctcaacactcgccaatcccacagccacagaagccacctaccaccgctccaccgatcgacgatgaggtcctcctcctggagaaggccctactggggctcttcgcggcggcggtgctggccatcgccgtcgcgaagctcgccggcaagcgcttccgcctcccgcccggcccctccggcgcccccatcgtcggcaactggctccaggtcggcgacgacctgaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgggtgggctgggaggaggaggccaggctcgtggtggaggacgtcaaggccgacccggcgtccgcgaccgccggcaccgtgatccgccgtaggctgcagctcatgatgtacaacgacatgttccgcatcatgttcgaccgcaggttcgagtccgtcgacgacccgctcttcaacaagctcaaggccatgaacgccgagcgcagcatcctgtcgcagagcttcgactacaactacggcgacttcatccccattctccgaccgttcctccgcaagtacctcaaccggtgcacaaacctcaagaccaagaggatgaagctcttcgaggaccacttcgtcgctgacagaaagaaggcgctggagcagaatggggagatcaggtgcgccatggaccacatcctggaggcggagaggaagggcgagatcaaccacgacaacgtcctctacatcgtcgagaacatcaacgttgcagccatcgagacaacgctgtggtcgatcgagtggggcatcgcggagctggtgaaccacccggacgtccagtcgaagctccgcgacgagatgaccgccgtgctgggcgccgacgtggcggtgacggagccggacctggagcgcctcccctacctgcagtccgtcgtgaaggagaccctccgcctccgcatggccatcccgctgctcgtgccgcacatgaatctcagcgacgccaagctcgccggctacgacatccccgccgagtccaagatcctcgtcaacgcatggttcctcgccaacgaccccaagcggtgggtgcgcgccgacgagttcaggcccgagcgcttcctcgaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgataccaccgagaagcccggacagttcagcaaccagatcctcaagcacgccaccgtcgtctgcaagccgctcgaggcctagaattttctatttgatcgtatggaggcttctgacatgcgtgtctgtgcatgcatgcgtgaacgctggtgccgggagatcgatctatgcacgcatgtgatgtgtattttcctttttttgtgcttttattttacttagttgcatttttgttggtcttcatgtgaggcgtcatgttgtagatttactatgttggtgataatgatgtaaaacttcttcaaaaaaaaaa

SEQ ID NO: 48 - protein, 489 aa, Lolium perenne
MRSSSWRRPYWGSSRRRCWPSPSRSSPASASASRPAPPAPPSSATGSRSATTTTATWASRSGSGRCSCSAWASATWWWCPARSWPRRCSTRRAWSSAPAPATSSSTSSPATARTWSSPSTATTGARCAGSPSPSSPTRWWRRTGWAGRRRPGSWWRTSRPTRRPRPPAPSAVGCSSCTTTCSASCSTAGSSPSTTRSSTSSRPTPSAASCRRASTTTTATSSPFSDRSSASTSTGAQTSRPRGSSSRTTSSLTERRRWSRMGRSGAPWTTSWRRRGRARSTTTTSSTSSRTSTLQPSRQRCGRSSGASRSWTTRTSSRSSATRPPCWAPTWRRSRTWSASPTCSPSRRPSASAWPSRCSCRTISATPSSPATTSPPSPRSSSTHGSSPTTPSGGCAPTSSGPSASSRRRRPSRPTATTSASCPSASAAGAAPGSSSRCPSSASRSDASCRTSSCCRRPGRTRSIPPRSPDSSATRSSSTPPSSASRSRP

SEQ ID NO: 49 - DNA, 1518 bp, Festuca arundinacea
  misc_feature (661)..(661): n is a, c, g, or t
atggatttcgtgttcgtggagaagctcctcgtcggccttcttgcgtccgtggtggtcgcgatcgtggtgtccatgatccgcggccgcaaactgaggctgccgcctggccccatccccgtgcccatcttcggcaactggctgcaggtcggggacgacctcaaccaccgcaacctggcggcgatggcccgcaagttcggcgaggtcttcctcctccgcatgggcatccgcaaccttgtggtggtgtccagcccggagctggccaaggaggtgctccacacgcagggcgtggagttcgggtcccggacccggaacgtggtgttcgacatcttcacgggcaaggggcaggacatggtgttcaccgtgtacggcgaccactggcgcaagatgcggcggatcatgacggtgcccttcttcacgaacaaggtggtgcagcagtaccgggccgggtgggaggcggaggggcctttcgtggtggacaacgtgcgcgccgaccccagggccgccaccgacggcgtggtgctccgccgccacctgcagctgatgatgtacaacaacatgtaccgcatcatgttcgaccggcggttcgagagcatggacgacccgctcttcctccgcctcagggagctcaacggcgagcgcagccgcctcgcgcagagcttcnagtacaactacggcgacttcatccccgtcctccgccccttcctccgcggctacctcaggctgtgcgagcaggtcaaggagacccgcctcaagctgttcaaggattacttcctggacgagaggaagaagctggcaagcaccaagcccatggacaacaacggcctcaagtgcgccattgatcacatcctggaggcgcagcagaagggggagatcaacgaggacaacgtcctctacatcatcgagaacatcaacgtcgccgcgatcgagacgacgttgtggtcgatcgagtgggggatcgcggagctggtgaaccacccggagatccagcagaagctgcgggacgagatggacgcggtgctgggcgccggccaccagatcacggagtccgacacgcacaggctcccctacctgcaggcggtgatcaaggagacgctgcggctgcgcatggccatcccgctgctggtgccgcacatgaacctccacgatgccaagctcgccggctacaacatccccgccgagagcaagatcctcgtcaacgcctggttcctcgccaacaacccggagcagtggaagcggcccgacgagttccgcccggagcgcttcctggaggaggagaggcacgtggaggccagcggcaacgacttcaggttcctgcccttcggcgtcggccgccggagctgcccggggatcatcctcgcgctgcccatcctcggcatcaccatcggccgcctcgtgcagaacttcgagctcaccacgccgcccggggtggacaagctcgacaccaccgagaagggcggccagttcagcctccacatcttgaaccactccaccatcgtcgccaagcccagagtgttctga

SEQ ID NO: 50 - protein, 505 aa, Festuca arundinacea
  misc_feature (221)..(221): Xaa can be any naturally occurring amino acid
MDFVFVEKLLVGLLASVVVAIVVSMIRGRKLRLPPGPIPVPIFGNWLQVGDDLNHRNLAAMARKFGEVFLLRMGIRNLVVVSSPELAKEVLHTQGVEFGSRTRNVVFDIFTGKGQDMVFTVYGDHWRKMRRIMTVPFFTNKVVQQYRAGWEAEGPFVVDNVRADPRAATDGVVLRRHLQLMMYNNMYRIMFDRRFESMDDPLFLRLRELNGERSRLAQSFXYNYGDFIPVLRPFLRGYLRLCEQVKETRLKLFKDYFLDERKKLASTKPMDNNGLKCAIDHILEAQQKGEINEDNVLYIIENINVAAIETTLWSIEWGIAELVNHPEIQQKLRDEMDAVLGAGHQITESDTHRLPYLQAVIKETLRLRMAIPLLVPHMNLHDAKLAGYNIPAESKILVNAWFLANNPEQWKRPDEFRPERFLEEERHVEASGNDFRFLPFGVGRRSCPGIILALPILGITIGRLVQNFELTTPPGVDKLDTTEKGGQFSLHILNHSTIVAKPRVF

SEQ ID NO: 51 - DNA, 1517 bp, Festuca arundinacea
  misc_feature (660)..(660): n is a, c, g, or t
atgatttcgtgttcgtggagaagctcctcgtcggccttcttgcgtccgtggtggtcgcgatcgtggtgtccatgatccgcggccgcaaactgaggctgccgcctggccccatccccgtgcccatcttcggcaactggctgcaggtcggggacgacctcaaccaccgcaacctggcggcgatggcccgcaagttcggcgaggtcttcctcctccgcatgggcatccgcaaccttgtggtggtgtccagcccggagctggccaaggaggtgctccacacgcagggcgtggagttcgggtcccggacccggaacgtggtgttcgacatcttcacgggcaaggggcaggacatggtgttcaccgtgtacggcgaccactggcgcaagatgcggcggatcatgacggtgcccttcttcacgaacaaggtggtgcagcagtaccgggccgggtgggaggcggaggggcctttcgtggtggacaacgtgcgcgccgaccccagggccgccaccgacggcgtggtgctccgccgccacctgcagctgatgatgtacaacaacatgtaccgcatcatgttcgaccggcggttcgagagcatggacgacccgctcttcctccgcctcagggagctcaacggcgagcgcagccgcctcgcgcagagcttcnagtacaactacggcgacttcatccccgtcctccgccccttcctccgcggctacctcaggctgtgcgagcaggtcaaggagacccgcctcaagctgttcaaggattacttcctggacgagaggaagaagctggcaagcaccaagcccatggacaacaacggcctcaagtgcgccattgatcacatcctggaggcgcagcagaagggggagatcaacgaggacaacgtcctctacatcatcgagaacatcaacgtcgccgcgatcgagacgacgttgtggtcgatcgagtgggggatcgcggagctggtgaaccacccggagatccagcagaagctgcgggacgagatggacgcggtgctgggcgccggccaccagatcacggagtccgacacgcacaggctcccctacctgcaggcggtgatcaaggagacgctgcggctgcgcatggccatcccgctgctggtgccgcacatgaacctccacgatgccaagctcgccggctacaacatccccgccgagagcaagatcctcgtcaacgcctggttcctcgccaacaacccggagcagtggaagcggcccgacgagttccgcccggagcgcttcctggaggaggagaggcacgtggaggccagcggcaacgacttcaggttcctgcccttcggcgtcggccgccggagctgcccggggatcatcctcgcgctgcccatcctcggcatcaccatcggccgcctcgtgcagaacttcgagctcaccacgccgcccggggtggacaagctcgacaccaccgagaagggcggccagttcagcctccacatcttgaaccactccaccatcgtcgccaagcccagagtgttctga

SEQ ID NO: 52 - protein, 496 aa, Festuca arundinacea
MISCSWRSSSSAFLRPWWSRSWCPSAAANGCRLAPSPCPSSATGCRSGTTSTTATWRRWPASSARSSSSAWASATLWWCPARSWPRRCSTRRAWSSGPGPGTWCSTSSRARGRTWCSPCTATTGARCGGSRCPSSRTRWCSSTGPGGRRRGLSWWTTCAPTPGPPPTAWCSAATCSCTTTCTASCSTGGSRAWTTRSSSASGSSTASAAASRRASSTTTATSSPSSAPSSAATSGCASRSRRPASSCSRITSWTRGRSWQAPSPWTTTASSAPLITSWRRSRRGRSTRTTSSTSSRTSTSPRSRRRCGRSSGGSRSWTTRRSSRSCGTRWTRCWAPATRSRSPTRTGSPTCRRSRRRCGCAWPSRCWCRTTSTMPSSPATTSPPRARSSSTPGSSPTTRSSGSGPTSSARSASWRRRGTWRPAATTSGSCPSASAAGAARGSSSRCPSSASPSAASCRTSSSPRRPGWTSSTPPRRAASSASTSTTPPSSPSPECS

SEQ ID NO: 53 - DNA, 1313 bp, Festuca arundinacea
ggtcccaagcccacccaatcctcaccagcatctctctcgcccacgcctccgatctcctctcgccgccgcgctcagtgccaagagaatgggcagcgtcgacgcctccgagaagacgatcaccgggtgggccgccagggacaccaccggtcacctctccccctacacgtacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccggaggtgagcaagtacagcgtcggcgacgtggttggcgtcggggtgatcgtcgggtgctgccacgactgccggccgtgcaaggccaacgttgagcagtactgcaacaagaagatctggtcgtacaacgacgtctacaccgacggcaagccaacgcagggcggcttcgcctccgccatggtcgtcgaccagaagttcgcggtgaagatcccggcggggctggcgccggagcaggcggcgccgctgctctgcgcgggggtgacggtgtacagcccactgaagcactttgggctgatgaccccaggcctccgcggcggcatcctgggcctcggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctcgactacatcatcgacaccgtgcccgtcaagcacccgctcgagccctacctcgcgctgctgaagatggacggcaagctcgtcctcatgggcgtgatcgccgagccgctcagcttcgtgtcccccatggtcatgctcgggaggaagaccatcacggggagcttcatcggcagcatcgaggagaccgaggaggtgctcaggttctgcgtcgaaaagggcctcacctcgcagatcgaggtcgtcaagatggactacctcaaccacgcccttgagaggctcgagcgcaacgacgtcaggtaccgcttcgtcgtcgacgtcgctgggagcaacatcaaggacgccgacgcctgatcgacttggaacctactccaagatagagcgcgataatttccgtgacatatgctcctcaactcggtgcagtacatgattgtgacctgtgtgtgaatttgtttccgtcttctatcagagtgcgtgctagtttccatggaaaaaa

SEQ ID NO: 54 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCHDCRPCKANVEQYCNKKIWSYNDVYTDGKPTQGGFASAMVVDQKFAVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 55 - DNA, 1312 bp, Festuca arundinacea
ggtcccaagcccacccaatcctcaccagcatctctctcgcccacgcctccgatctcctctcgccgccgcgctcagtgccaagagaatggcagcgtcgacgcctccgagaagacgatcaccgggtgggccgccagggacaccaccggtcacctctccccctacacgtacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccggaggtgagcaagtacagcgtcggcgacgtggttggcgtcggggtgatcgtcgggtgctgccacgactgccggccgtgcaaggccaacgttgagcagtactgcaacaagaagatctggtcgtacaacgacgtctacaccgacggcaagccaacgcagggcggcttcgcctccgccatggtcgtcgaccagaagttcgcggtgaagatcccggcggggctggcgccggagcaggcggcgccgctgctctgcgcgggggtgacggtgtacagcccactgaagcactttgggctgatgaccccaggcctccgcggcggcatcctgggcctcggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctcgactacatcatcgacaccgtgcccgtcaagcacccgctcgagccctacctcgcgctgctgaagatggacggcaagctcgtcctcatgggcgtgatcgccgagccgctcagcttcgtgtcccccatggtcatgctcgggaggaagaccatcacggggagcttcatcggcagcatcgaggagaccgaggaggtgctcaggttctgcgtcgaaaagggcctcacctcgcagatcgaggtcgtcaagatggactacctcaaccacgcccttgagaggctcgagcgcaacgacgtcaggtaccgcttcgtcgtcgacgtcgctgggagcaacatcaaggacgccgacgcctgatcgacttggaacctactccaagatagagcgcgataatttccgtgacatatgctcctcaactcggtgcagtacatgattgtgacctgtgtgtgaatttgtttccgtcttctatcagagtgcgtgctagtttccatggaaaaaa

SEQ ID NO: 56 - protein, 348 aa, Festuca arundinacea
MAASTPPRRRSPGGPPGTPPVTSPPTRTPSGGRALKMWCRFCTAASATLTSTRPRTTLVPQNTPWFPGMRWARWWRSGRRASTASATWLASGSSGAATTAGRARPTLSSTATRRSGRTTTSTPTASQRRAASPPPWSSTRSSRRSRRGWRRSRRRRCSARGRCTAHSTLGPQASAAASWASAAWATWARWPSPWATTSPSAPPTRSAPRPWTTSAPTPTSSAPTRPRWPPPWTRSTTSSTPCPSSTRSSPTSRCRWTASSSSWASPSRSASCPPWSCSGGRPSRGASSAASRRPRRCSGSASKRASPRRSRSSRWTTSTTPLRGSSATTSGTASSSTSLGATSRTPTP

SEQ ID NO: 57 - DNA, 1358 bp, Lolium perenne
cctcaccagcacctctctcgcccacgcctccgatctcctctcgccgccgcgctcggtgccaagagaatgggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgcctcctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctacattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaa

SEQ ID NO: 58 - protein, 361 aa, Lolium perenne
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 59 - DNA, 1357 bp, Lolium perenne
cctcaccagcacctctctcgcccacgcctccgatctcctctcgccgccgcgctcggtgccaagagaatggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgcctcctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctacattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaa

SEQ ID NO: 60 - protein, 350 aa, Lolium perenne
MAASTPPRRRSPAGPPGTPPATSPRTRTTSGGRALKMWCRFCTAASATLTSTRPRTTLVLQNTPWFPGMRWARWWRSGRRASTASAMWSAWGSLGAAATAGRARPTLSSTATRRSGRTTTSTPTESPRRAASPPPWSSTRSSWRSQRGRRSRRRRCCALASRCTARSTSGPRASAAASSAWAAWATWARWPSPWATTSPSAPPTRSAPRPWTTWAPTPTSSAPTRPRWPPPWTRWTTSSTPCPSSTRSSPTSRCSRWTASSSSWASLASRSASCPPWSCSGGRPSRAASSGASRRPRRCSGSASTRASPRRSRSSRWTTSTRRLRGSSATTSGTASSSTSQGATSTTLPH

SEQ ID NO: 61 - DNA, 1501 bp, Festuca arundinacea
ctccgatctcctctcgccgccgcgctcggtgcaaagagaatgggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctagactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgatgtcgcagggagcaacatcgacgacactgccgcgtgatcgacttggcaacgacgagcgaacctacattgagcgctataatttcagtgacatatgctcctcaactttgcagtacatgattgtgaactgtgtgactgtgtttccgtcttctatcagagattcagagtgtgcatgttagtttcaatagggagaaatgtttggtataagtccggcctaataataacggattttcatgtccctgtcgacctcgacctctctttttcatggagctgtttttgctacaggatgtgattcacgccaagtttgactcccacatgtcaaggttttattaggaaagatcgaactaaatcacaaatatcacttagttatttggtcggagatttgtagaccaaaagaaaaaaaaaaaaaaaaaaaa

SEQ ID NO: 62 - protein, 361 aa, Festuca arundinacea
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNQALERLERNDVRYRFVVDVAGSNIDDTAA

SEQ ID NO: 63 - DNA, 1500 bp, Festuca arundinacea
ctccgatctcctctcgccgccgcgctcggtgcaaagagaatggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctagactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgatgtcgcagggagcaacatcgacgacactgccgcgtgatcgacttggcaacgacgagcgaacctacattgagcgctataatttcagtgacatatgctcctcaactttgcagtacatgattgtgaactgtgtgactgtgtttccgtcttctatcagagattcagagtgtgcatgttagtttcaatagggagaaatgtttggtataagtccggcctaataataacggattttcatgtccctgtcgacctcgacctctctttttcatggagctgtttttgctacaggatgtgattcacgccaagtttgactcccacatgtcaaggttttattaggaaagatcgaactaaatcacaaatatcacttagttatttggtcggagatttgtagaccaaaagaaaaaaaaaaaaaaaaaaaa

SEQ ID NO: 64 - protein, 349 aa, Festuca arundinacea
MAASTPPRRRSPGGPPGTPPATSPPTRTTSGGRALKMWCRFCTAASATLTSTRPRTTLVLQNTPWYPGMRWARWWRSGRRASTASATWSAWGSSGAAATAGRARPTLSSTATRRSGRTTTSTPTASPRRAASPPPWSSTRSSWRSRRGWRRSRRRRCSARGRCTARSTSGPQASVAASWAWAAWATWARWPSPWATTSPSAPPTRSAPRPWTTSAPTPTSSAPTRPRWPPPWTRTTSSTPCPSSTRSSPTWRCSRWTASSSSWASSPSRSASCPPWSCSEGRPSPAASSGASRRPRRCLGSASKRASPRRSRSSRWTTSTRRSRGSSATTSGTASSSMSQGATSTTLPR

SEQ ID NO: 65 - DNA, 1339 bp, Festuca arundinacea
ctccgatctcctctcgccgccgcgctcggtgcaaagagaatgggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctcctccatggtcgtcgaccagaagttcgtggtgaagatcccagcggggctagcgccggagcaggcggcgccgctgctgtgcgccggcgtgaccgtgtacagcccgctgaagcacttcgggctgatgaccccgggcctccgcggcggcatcctcggcctcggcggcgtcggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctcctcaagatggacggcaagctcgtcctcatgggcgtcatcggcgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgacgtcgcagggagcaacatcgacgacactgccgcgtgatcgacttggcaacgacgagcgaacctacattgagcgctataatttcagtgacatatgctcctcaactttgcagtacatgattgtgaactgtgtgactgtgtttccgtcttctatcagagattcagagtgtgcatgttagtttcaatagggagaaatgtttggtataagtccggcctaataataacggattttcaaaaaaaaaaaaaaaaaaaaa

SEQ ID NO: 66 - protein, 361 aa, Festuca arundinacea
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVEKGLTSQIEVVKMDYLNQALERLERNDVRYRFVVDVAGSNIDDTAA

SEQ ID NO: 67 - DNA, 1338 bp, Festuca arundinacea
ctccgatctcctctcgccgccgcgctcggtgcaaagagaatggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctcctccatggtcgtcgaccagaagttcgtggtgaagatcccagcggggctagcgccggagcaggcggcgccgctgctgtgcgccggcgtgaccgtgtacagcccgctgaagcacttcgggctgatgaccccgggcctccgcggcggcatcctcggcctcggcggcgtcggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctcctcaagatggacggcaagctcgtcctcatgggcgtcatcggcgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgacgtcgcagggagcaacatcgacgacactgccgcgtgatcgacttggcaacgacgagcgaacctacattgagcgctataatttcagtgacatatgctcctcaactttgcagtacatgattgtgaactgtgtgactgtgtttccgtcttctatcagagattcagagtgtgcatgttagtttcaatagggagaaatgtttggtataagtccggcctaataataacggattttcaaaaaaaaaaaaaaaaaaaaa

SEQ ID NO: 68 - protein, 349 aa, Festuca arundinacea
MAASTPPRRRSPGGPPGTPPATSPPTRTTSGGRALKMWCRFCTAASATLTSTRPRTTLVLQNTPWYPGMRWARWWRSGRRASTASATWSAWGSSGAAATAGRARPTLSSTATRRSGRTTTSTPTASPRRAASPPPWSSTRSSWRSQRGRRSRRRRCCAPAPCTARSTSGPRASAAASSASAASATWARWPSPWATTSPSAPPTRSAPRPWTTWAPTPTSSAPTRPRWPPPWTRWTTSSTPCPSSTRSSPTSRSSRWTASSSSWASSASRSASCPPWSCSEGRPSPAASSGASRRPRRCLGSASKRASPRRSRSSRWTTSTRRSRGSSATTSGTASSSTSQGATSTTLPR

SEQ ID NO: 69 - DNA, 1322 bp, Festuca arundinacea
ggcaccagcccaagcccacccaatcctcaccagcatctctctcgcccaagcctccgatctcctctcgccgccgcgctcggtgccaagagaatgggcagcgtggacgcctccgagaagacgatcaccgggtgggccgccagggacaccaccggtcacctctccccctacacctacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccagaggtgagcaagtacagcgtcggcgacgtggtcggcgttggggtgatcgtcgggtgctgccgcgactgcaggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggacgctgccatggactcgctggactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcgggaggaagaccatcaccgggagcttcatcgggagcatcgaggagaccgaggaggtgctcaggttctgcgtcgaaaaggggctcacctcgcagatcgaggtcgtcaagatggactacctcaaccacgcgctcgagaggctcgagcgcaacgatgtcaggtaccgcttcgtcgtcgacgtcgctgggagcaacatcaaggacgccgacgcctgatcgacttggaacctacaagatagagcgcgataatttccgtgacatttgctcctcaactcggtgcagtacatgattgtgacctgtgtgtgaatttgtttccgtcttctatggagatgcatgtttgctataaaaaaaaaaaaaaaaaa

SEQ ID NO: 70 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMDAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 71 - DNA, 1321 bp, Festuca arundinacea
ggcaccagcccaagcccacccaatcctcaccagcatctctctcgcccaagcctccgatctcctctcgccgccgcgctcggtgccaagagaatggcagcgtggacgcctccgagaagacgatcaccgggtgggccgccagggacaccaccggtcacctctccccctacacctacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccagaggtgagcaagtacagcgtcggcgacgtggtcggcgttggggtgatcgtcgggtgctgccgcgactgcaggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggacgctgccatggactcgctggactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcgggaggaagaccatcaccgggagcttcatcgggagcatcgaggagaccgaggaggtgctcaggttctgcgtcgaaaaggggctcacctcgcagatcgaggtcgtcaagatggactacctcaaccacgcgctcgagaggctcgagcgcaacgatgtcaggtaccgcttcgtcgtcgacgtcgctgggagcaacatcaaggacgccgacgcctgatcgacttggaacctacaagatagagcgcgataatttccgtgacatttgctcctcaactcggtgcagtacatgattgtgacctgtgtgtgaatttgtttccgtcttctatggagatgcatgtttgctataaaaaaaaaaaaaaaaaa

SEQ ID NO: 72 - protein, 350 aa, Festuca arundinacea
MAAWTPPRRRSPGGPPGTPPVTSPPTPTPSGGRALKMWCRFCTAASATLTSTRPRTTLVPQNTPWFPGMRWARWWRSGQRASTASATWSALGSSGAAATAGRARPTLSSTATRRSGRTTTSTPTASPRRAASPPPWSSTRSSWRSRRGWRRSRRRRCSARGRCTARSTSGPQASVAASWAWAAWATWARWPSPWATTSPSAPPTRSAPRPWTTSAPTPTSSAPTRPRWTLPWTRWTTSSTPCPSSTRSSPTWRCSRWTASSSSWASSPSRSASCPPWSCSGGRPSPGASSGASRRPRRCSGSASKRGSPRRSRSSRWTTSTTRSRGSSATMSGTASSSTSLGATSRTPTP

SEQ ID NO: 73 - DNA, 1313 bp, Festuca arundinacea; identical to SEQ ID NO: 53

SEQ ID NO: 74 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGPTSQIEVVKMDYLNHALERLERNDVRYRFVVDVAGSNIKDADA

SEQ ID NO: 75 - DNA, 1525 bp, Festuca arundinacea
ggcacgagcccaagcccacccaatcctcaccagcatctctctcgcccaagcctccgatctcctctcgccgccgcgctcggtgccaagagaatggcagcgtggacgcctccgagaagacgatcaccgggtgggccgccagggacaccaccggtcacctctccccctacacctacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccagaggtgagcaagtacagcgtcggcgacgtggtcggcgttggggtgatcgtcgggtgctgccgcgactgcaggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctagactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcgggaggaagaccatcaccgggagcttcatcgggagcatcgaggagaccgaggaggtgctcaggttctgcgtcgaaaaggggcccacctcgcagatcgaggtcgtcaagatggactacctcaaccacgcgctcgagaggctcgagcgcaacgacgtcaggtaccgcttcgtcgtcgacgtcgctgggagcaacatcaaggacgccgacgcctgatcgacttggaacctacaagatagagcgcgataatttccgtgacatttgctcctcaactcggtgcagtacatgattgtgacctgtgtgtgaatttgtttccgtcttctatggagatgcatgtttgctataaatccggccacgactcaatctggcagatgtttttcttaacggaattcgttcggtgtgtcaattagttccggtggtgtgtttgtttgtcgtatatacccttgcttgtttcggtggtatactcatcgctttgatagtcggtggggctatgcccttgcttgttttcacccatttttctaactaatcgagaaagcgctatatatagcagggtaaaaaaaaaaaaa

SEQ ID NO: 76 - protein, 349 aa, Festuca arundinacea
MAAWTPPRRRSPGGPPGTPPVTSPPTPTPSGGRALKMWCRFCTAASATLTSTRPRTTLVPQNTPWFPGMRWARWWRSGQRASTASATWSALGSSGAAATAGRARPTLSSTATRRSGRTTTSTPTASPRRAASPPPWSSTRSSWRSRRGWRRSRRRRCSARGRCTARSTSGPQASVAASWAWAAWATWARWPSPWATTSPSAPPTRSAPRPWTTSAPTPTSSAPTRPRWPPPWTRTTSSTPCPSSTRSSPTWRCSRWTASSSSWASSPSRSASCPPWSCSGGRPSPGASSGASRRPRRCSGSASKRGPPRRSRSSRWTTSTTRSRGSSATTSGTASSSTSLGATSRTPTP

SEQ ID NO: 77 - DNA, 1325 bp, Lolium perenne
ggcacgagcaacaagtcatcaatggcggaaggcttgccggcgctcggttgggctgcgagggacgcctccggtcacctctccccttacagcttctcgagaagcgttccgaaggacgacgatgtgacgatcaaggtgctcttctgcgggatctgccacactgacctccacatcatcaagaacgactggggcaacgccctctaccccatcgtcccagggcatgagatcgtgggcgtcgtcgccagcgtcggcagcggcgtcagcagcttcaaggccggcgacacggtgggcgtgggctacttcctcgactcctgccgcacctgctacagctgcagcaaggggtacgagaacttctgccccaccctgacgctcacctccaacggcgtcgacggcggcggcgccaccacccagggcggcttctccgacgtcctcgtcgtcaacaaggactacgtcatccgcgtcccggacaacctgcccctggccggcgcggcacctctcctctgcgccggcgtcacagtctacagccctatggtggagtacggcctcaacgcccccgggaagcacctcggcgtcgtcggcctgggcgggctcggccacgtcgccgtcaagttcggcaaggccttcgggatgaccgtcaccgtcatcagctcctcggacaggaagcgcgacgaggcgctcggccgcctcggcgccgacgccttcctcgtcagcagcgaccccgagcagatgaaggcggcggcgggcaccatggacggcatcatcgacacggtgtccgcgggccacccgatcgtgccgctgctcgacctgctcaagcccatggggcagatggtcgtggtgggcgcgcccagcaagccgctcgagctcccggccttcgccatcatcggcggcggcaagcgcctcgccgggagcggcaccggcagcgtcgcacactgccaggccatgctcgacttcgcgggcaagcacggcatcaccgccgacgtcgaggtcgtcaagatggactacggtcaacaccgccatcgagcggctagagaagaacgacgtcaggtaccgcttcgtcatcgacgtcgccggcagccacctgcagggcaccgccgcttaacttgtgctacacaatgtggacgcgcgctcgtttggtccagaaaaaggttcgccggctcacagccacatgaacaagtcaatgagtcgttggtgtgttgtttatcttcattccacatatgggacgcagttccagattttcatgtcaaataattgcgtcgtgtgcggttgtcaagactcaaataggagaaaaaaagactcgtgatttcgttttgcaaaaaaaaaaaaaaaaa

SEQ ID NO: 78 - protein, 407 aa, Lolium perenne
MAEGLPALGWAARDASGHLSPYSFSRSVPKDDDVTIKVLFCGICHTDLHIIKNDWGNALYPIVPGHEIVGVVASVGSGVSSFKAGDTVGVGYFLDSCRTCYSCSKGYENFCPTLTLTSNGVDGGGATTQGGFSDVLVVNKDYVIRVPDNLPLAGAAPLLCAGVTVYSPMVEYGLNAPGKHLGVVGLGGLGHVAVKFGKAFGMTVTVISSSDRKRDEALGRLGADAFLVSSDPEQMKAAAGTMDGIIDTVSAGHPIVPLLDLLKPMGQMVVVGAPSKPLELPAFAIIGGGKRLAGSGTGSVAHCQAMLDFAGKHGITADVEVVKMDYGQHRHRAAREERRQVPLRHRRRRQPPAGHRRLTCATQCGRALVWSRKRFAGSQPHEQVNESLVCCLSSFHIWDAVPDFHVK

SEQ ID NO: 79 - DNA, 1324 bp, Lolium perenne
ggcacgagcaacaagtcatcaatgcggaaggcttgccggcgctcggttgggctgcgagggacgcctccggtcacctctccccttacagcttctcgagaagcgttccgaaggacgacgatgtgacgatcaaggtgctcttctgcgggatctgccacactgacctccacatcatcaagaacgactggggcaacgccctctaccccatcgtcccagggcatgagatcgtgggcgtcgtcgccagcgtcggcagcggcgtcagcagcttcaaggccggcgacacggtgggcgtgggctacttcctcgactcctgccgcacctgctacagctgcagcaaggggtacgagaacttctgccccaccctgacgctcacctccaacggcgtcgacggcggcggcgccaccacccagggcggcttctccgacgtcctcgtcgtcaacaaggactacgtcatccgcgtcccggacaacctgcccctggccggcgcggcacctctcctctgcgccggcgtcacagtctacagccctatggtggagtacggcctcaacgcccccgggaagcacctcggcgtcgtcggcctgggcgggctcggccacgtcgccgtcaagttcggcaaggccttcgggatgaccgtcaccgtcatcagctcctcggacaggaagcgcgacgaggcgctcggccgcctcggcgccgacgccttcctcgtcagcagcgaccccgagcagatgaaggcggcggcgggcaccatggacggcatcatcgacacggtgtccgcgggccacccgatcgtgccgctgctcgacctgctcaagcccatggggcagatggtcgtggtgggcgcgcccagcaagccgctcgagctcccggccttcgccatcatcggcggcggcaagcgcctcgccgggagcggcaccggcagcgtcgcacactgccaggccatgctcgacttcgcgggcaagcacggcatcaccgccgacgtcgaggtcgtcaagatggactacggtcaacaccgccatcgagcggctagagaagaacgacgtcaggtaccgcttcgtcatcgacgtcgccggcagccacctgcagggcaccgccgcttaacttgtgctacacaatgtggacgcgcgctcgtttggtccagaaaaaggttcgccggctcacagccacatgaacaagtcaatgagtcgttggtgtgttgtttatcttcattccacatatgggacgcagttccagattttcatgtcaaataattgcgtcgtgtgcggttgtcaagactcaaataggagaaaaaaagactcgtgatttcgttttgcaaaaaaaaaaaaaaaaa

SEQ ID NO: 80 - protein, 402 aa, Lolium perenne
MRKACRRSVGLRGTPPVTSPLTASREAFRRTTMRSRCSSAGSATLTSTSSRTTGATPSTPSSQGMRSWASSPASAAASAASRPATRWAWATSSTPAAPATAAARGTRTSAPPRSPPTASTAAAPPPRAASPTSSSSTRTTSSASRTTCPWPARHLSSAPASQSTALWWSTASTPPGSTSASSAWAGSATSPSSSARPSGPSPSSAPRTGSATRRSAASAPTPSSSAATPSRRRRRAPWTASSTRCPRATRSCRCSTCSSPWGRWSWWARPASRSSSRPSPSSAAASASPGAAPAASHTARPCSTSRASTASPPTSRSSRWTTVNTAIERLEKNDVRYRFVIDVAGSHLQGTAALVLHNVDARSFGPEKGSPAHSHMNKSMSRWCVVYLHSTYGTQFQIFMSN

SEQ ID NO: 81 - DNA, 1378 bp, Lolium perenne; identical to SEQ ID NO: 16

SEQ ID NO: 82 - protein, 370 aa, Lolium perenne
MAPTAAEQTEHHQHTRKAVGLAARDDAGHLSPLAITRRSTGDDDVVIKILYCGICHSDLHALKNDWKNSRYPMIPGHEIAGEVTEVGKNVSKFKAGDRVGVGCMVNSCRSCESCDKGFENHCPGMILTYNSVDVDGTVTYGGYSSMVVVHERFVVRFPDAMPLDKGAPLLCAGITVYSPMKYHGLNVPGLHLGVLGLGGLGHVAVKFGKAFGMKVTVISSSPGKKEEALGRLGADAFIVSKDADEMKAVMSTMDGIINTVSANIPLTPLFGLLKPNGKMIMVGLPEKPIEIPPFALVATNKTLAGSIIGGMSDTQEMLDLAAKHGVTADIEVVGAEYVNTALERLAKNDVRYRFVIDIGNTLDNVAATTE

SEQ ID NO: 83 - DNA, 1377 bp, Lolium perenne
ggcacgagtcgcctccaacgtcttcccttaaccggccgtccctacgcttgcaccaccaccacgcacagacagagcagtttcccagcccccgccggaaccggatgcacccacggcggcggagcagacggagcaccaccagcacaccaggaaggcggtggggctggcggcgcgcgacgacgccggccacctctccccgctcgccatcacacggaggagcacaggagacgacgatgtggtgataaagattttgtactgcggaatctgccactctgacctgcacgccctgaagaacgactggaagaactcaaggtacccgatgatccccgggcacgagatcgccggcgaggtcacggaggtgggcaagaacgtgagcaagttcaaggccggcgaccgcgtgggcgtcgggtgcatggtgaactcgtgccggtcgtgcgagagctgcgacaagggcttcgagaaccactgcccgggcatgatcctcacctacaactcggtcgacgtcgacggcaccgtcacctacggcggctactccagcatggtggtggtgcacgagcggttcgtggtccggttccccgacgccatgccgctggacaagggcgcgccgctgctgtgcgccggcatcaccgtgtacagccccatgaagtaccacgggctcaacgttcccgggctgcacctcggcgtgctggggctgggcgggctgggccacgttgcggtcaagttcggcaaggccttcggaatgaaagtgacggtgatcagctcgtcgccggggaagaaggaggaggccctggggcggctgggcgccgacgcgttcatcgtcagcaaggacgccgacgagatgaaggctgtgatgagcaccatggatggcatcataaacacggtatctgcaaacatccccctgacccctctcttcgggctgctcaagcccaacggcaagatgatcatggtcggcctccccgagaagcccatcgagattcctcccttcgctctagttgccacgaataagaccctggccgggagcatcatcggcggcatgagcgacacgcaggagatgctggacctcgcggcgaagcacggcgtgacggccgacatcgaggtggtcggcgcggagtatgtgaacacggccttggagcgccttgccaagaacgacgtcaggtatcgcttcgtcatcgacatcggcaacaccctcgacaatgttgcggccaccaccgagtgaacgtactcagcactgcttacgatctacgttgttccactgttagtgctccgtagtaaacaataaacgatcaaaactcttgtcatctggtgcattggtgtagacatggttgtttgcgaggaaactgagttgaaggatggatggataaaaaaaaaaaaaaaaaaaaa

SEQ ID NO: 84 - protein, 349 aa, Lolium perenne
MHPRRRSRRSTTSTPGRRWGWRRATTPATSPRSPSHGGAQETTMWRFCTAESATLTCTPRTTGRTQGTRSPGTRSPARSRRWARTASSRPATAWASGAWTRAGRARAATRASRTTARASSPTTRSTSTAPSPTAATPAWWWCTSGSWSGSPTPCRWTRARRCCAPASPCTAPSTTGSTFPGCTSACWGWAGWATLRSSSARPSEKRSARRRGRRRRPWGGWAPTRSSSARTPTRRLAPWMASTRYLQTSPPLSSGCSSPTARSWSASPRSPSRFLPSLLPRIRPWPGASSAAATRRRCWTSRRSTARPTSRWSARSMTRPWSALPRTTSGIASSSTSATPSTMLRPPPS

SEQ ID NO: 85 - DNA, 1382 bp, Lolium perenne
ggcacgagcccaatcctcaccagcacctctctcgcccacgcctccgatctcctctcgccgccgcgctcggtgccaagagaatgggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgctggctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgactacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctacattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaaaaaaaaaaaa

SEQ ID NO: 86 - protein, 361 aa, Lolium perenne
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFAGSMVVDQKFVVKIPAGLAPEQAAPLLCAGVTVYSPLKHFGLMTPGLRGGILGLGGVGHMGVKVAKSMGHHVTVISSSDKKRAEAMDDLGADDYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 87 - DNA, 1381 bp, Lolium perenne
ggcacgagcccaatcctcaccagcacctctctcgcccacgcctccgatctcctctcgccgccgcgctcggtgccaagagaatggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgctggctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgactacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctacattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaaaaaaaaaaaa

SEQ ID NO: 88 - protein, 350 aa, Lolium perenne
MAASTPPRRRSPAGPPGTPPATSPRTRTTSGGRALKMWCRFCTAASATLTSTRPRTTLVLQNTPWFPGMRWARWWRSGRRASTASAMWSAWGSLGAAATAGRARPTLSSTATRRSGRTTTSTPTESPRRAASLAPWSSTRSSWRSQRGRRSRRRRCCALASRCTARSTSGPRASAAASSAWAAWATWARWPSPWATTSPSAPPTRSAPRPWTTWAPTTTSSAPTRPRWPPPWTRWTTSSTPCPSSTRSSPTSRCSRWTASSSSWASLASRSASCPPWSCSGGRPSRAASSGASRRPRRCSGSASTRASPRRSRSSRWTTSTRRLRGSSATTSGTASSSTSQGATSTTLPH

SEQ ID NO: 89 - DNA, 1063 bp, Festuca arundinacea
ggtcgactcagcaagacagcccaatcatccagcccagatctcgcgcgtttccttcctccagctaaagaccggcaatggcgaccacggcggctgatgccacggccacggtgcccaaggagcagcccgccaccaacggcgccgccagcggtgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgcaaagaagaccatggagatcggcgtctacaccggctactccctcctcgccaccgcgctcgccatcccagaagacggcacgatcttggccatggacatcaaccgcgagaactacgagaccatcggcaagccgtgcatcgagaaggccggcgtggcgcacaagatcgacttccgcgaggggcccgcgctcccggtcctggacgagctgctcgaggacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtagtgctccccgccgacgcgcccatgcgcaagtacatccgctactaccgcgacttcgtcctcgagctcaacaaggccctcgccgcagacgaccgcgtcgagatctgccagctccccgtcggcgacggcatcaccctctgccgccgcgccaagtgattgtctgattgatgacgctcgcgcgccgccccctctgctccgctccatggatgcggacaagaattaattaattattccccattttgcctttcttgctttcttctgtatcttcttggaaacaaatattgtccttttatgtacgtatacaaatttatatccagacaaataatattactcctataaaaaaaaaa

SEQ ID NO: 90 - protein, 265 aa, Festuca arundinacea
MATTAADATATVPKEQPATNGAASGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDELLEDEANHGSFDFVFVDADKDNYLNYHQRLMKLVRVGGLIGYDNTLWNGSVVLPADAPMRKYIRYYRDFVLELNKALAADDRVEICQLPVGDGITLCRRAK

SEQ ID NO: 91 - DNA, 1062 bp, Festuca arundinacea
ggtcgactcagcaagacagcccaatcatccagcccagatctcgcgcgtttccttcctccagctaaagaccggcaatgcgaccacggcggctgatgccacggccacggtgcccaaggagcagcccgccaccaacggcgccgccagcggtgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgcaaagaagaccatggagatcggcgtctacaccggctactccctcctcgccaccgcgctcgccatcccagaagacggcacgatcttggccatggacatcaaccgcgagaactacgagaccatcggcaagccgtgcatcgagaaggccggcgtggcgcacaagatcgacttccgcgaggggcccgcgctcccggtcctggacgagctgctcgaggacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtagtgctccccgccgacgcgcccatgcgcaagtacatccgctactaccgcgacttcgtcctcgagctcaacaaggccctcgccgcagacgaccgcgtcgagatctgccagctccccgtcggcgacggcatcaccctctgccgccgcgccaagtgattgtctgattgatgacgctcgcgcgccgccccctctgctccgctccatggatgcggacaagaattaattaattattccccattttgcctttcttgctttcttctgtatcttcttggaaacaaatattgtccttttatgtacgtatacaaatttatatccagacaaataatattactcctataaaaaaaaaa

SEQ ID NO: 92 - protein, 260 aa, Festuca arundinacea
MRPRRLMPRPRCPRSSPPPTAPPAVPSRSPATPRSATRACSRATRSTSTSWRPPCTRASTSASSSARTPPTTHGTPRRRTRASSSTCSSSSSAQRRPWRSASTPATPSSPPRSPSQKTARSWPWTSTARTTRPSASRASRRPAWRTRSTSARGPRSRSWTSCSRTRPTTAPSTSSSSTPTRTTTSTTTSASSSSGSAASSATTTRSGTDPCSPPTRPCASTSATTATSSSSSTRPSPQTTASRSASSPSATASPSAAAPS

SEQ ID NO: 93 - DNA, 1051 bp, Lolium perenne
caatcatccagcccagatctcacgcgtttccttcctccagctaaagaccggcaatggcgaccacggcggctgatgccacggccacggttgccaaggagcagaccaccaccaacggcgccgccagcggtgccgagcaggtcacccgccactccgaggtcgggcacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctcgaggacgaggccaaccacggcaccttcgacttcgtcttcgtcgacgccgacaaggacaactacctcaactaccaccagcgcctcatgaagctcgtcagggtcggcggcctcctcggctacgacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcaccctctgccgccgcgccaagtgattgtctgattgatgacgcgagcgcgccgccccctcggctccgctccgctccatggatgcggacaagaattgattaattattattccccattttgccgttctggctttcttctgtatcttcttggaaacaaatattgtccctttatgtacgtatatcaaatttatatccagacaaataatattactcctataaaaaaaaaa

SEQ ID NO: 94 - protein, 265 aa, Lolium perenne
MATTAADATATVAKEQTTTNGAASGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDELLEDEANHGTFDFVFVDADKDNYLNYHQRLMKLVRVGGLLGYDNTLWNGSVVLPADAPMRKYIRYYRDFVLELNKALAADDRVEICQLPVGDGITLCRRAK

SEQ ID NO: 95 - DNA, 1050 bp, Lolium perenne
caatcatccagcccagatctcacgcgtttccttcctccagctaaagaccggcaatgcgaccacggcggctgatgccacggccacggttgccaaggagcagaccaccaccaacggcgccgccagcggtgccgagcaggtcacccgccactccgaggtcgggcacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctcgaggacgaggccaaccacggcaccttcgacttcgtcttcgtcgacgccgacaaggacaactacctcaactaccaccagcgcctcatgaagctcgtcagggtcggcggcctcctcggctacgacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcaccctctgccgccgcgccaagtgattgtctgattgatgacgcgagcgcgccgccccctcggctccgctccgctccatggatgcggacaagaattgattaattattattccccattttgccgttctggctttcttctgtatcttcttggaaacaaatattgtccctttatgtacgtatatcaaatttatatccagacaaataatattactcctataaaaaaaaaa

SEQ ID NO: 96 - protein, 261 aa, Lolium perenne
MRPRRLMPRPRLPRSRPPPTAPPAVPSRSPATPRSGTRACSRATRSTSTSWRPPCTRASTSASSSARTPPTTHGTPRRRTRASSSTCSSSSSAPRRPWRSASTPATPSSPPRSPSPRTARSWPWTSTARTTRPSASRASRRPASRTRSTSARGPRSRCSTSCSRTRPTTAPSTSSSSTPTRTTTSTTTSASSSSGSAASSATTTRSGTDPSCSPPTRPCASTSATTATSSSSLTRPSPQTTASRSASSPSATASPSAAAPS

SEQ ID NO: 97 - DNA, 1126 bp, Lolium perenne
gaattcactagtgattaagcagtggtaacaacgcagagtacgcggggaacgccaatcagtcgactcagcaagacagcccaatcatccagcccagatctcgcgcgtttccttcctccagctaaagacccgcaatggcgaccacggcggctgatgccacggccacggtggccaaggagcagaccaccactaacggcgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctcatgaccacgtcggcggacgagggccagttcctcaacctgctcatcaagctcatcggcgcaaagaagaccatggagatcggcgtctacaccggctactccctcctcgccaccgcgctcgccatcccagaagacggaaccatcttggccatggacatcaaccgcgagaactacgagaccatcggcaagccgtgcatcgagaaggccggcgtcgcgcacaagatcgacttccgcgagggccccgcgctcccggtcctggacgcgctgctcgacgacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtcgtgctccccgccgacgcgcccatgcgcaagtacatccgctactaccgcgacttcgtcctcgagctcaacaaggccctcgccgccgacgaccgcgtcgagatctgccagcttcccgtcggcgacggcatcacgctctgccgccgcgccaagtgattgtttgattgatgacgcgcgcgcgcgccgccccctttgctccgctccatggatgcggacaagaattaattaattattattccccattttgccgttcttgcttttttctgtattttctcggaaattgtccctttatgtacgtatacaaatttatatccagacaaataatattactcctataaaaaaaaaaaaaaaaaaaaaaaaaaaaa

SEQ ID NO: 98 - protein, 261 aa, Lolium perenne
MATTAADATATVAKEQTTTNGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDALLDDEANHGSFDFVFVDADKDNYLNYHQRLMKLVRVGGLIGYDNTLWNGSVVLPADAPMRKYIRYYRDFVLELNKALAADDRVEICQLPVGDGITLCRRAK

SEQ ID NO: 99 - DNA, 1125 bp, Lolium perenne
gaattcactagtgattaagcagtggtaacaacgcagagtacgcggggaacgccaatcagtcgactcagcaagacagcccaatcatccagcccagatctcgcgcgtttccttcctccagctaaagacccgcaatgcgaccacggcggctgatgccacggccacggtggccaaggagcagaccaccactaacggcgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctcatgaccacgtcggcggacgagggccagttcctcaacctgctcatcaagctcatcggcgcaaagaagaccatggagatcggcgtctacaccggctactccctcctcgccaccgcgctcgccatcccagaagacggaaccatcttggccatggacatcaaccgcgagaactacgagaccatcggcaagccgtgcatcgagaaggccggcgtcgcgcacaagatcgacttccgcgagggccccgcgctcccggtcctggacgcgctgctcgacgacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtcgtgctccccgccgacgcgcccatgcgcaagtacatccgctactaccgcgacttcgtcctcgagctcaacaaggccctcgccgccgacgaccgcgtcgagatctgccagcttcccgtcggcgacggcatcacgctctgccgccgcgccaagtgattgtttgattgatgacgcgcgcgcgcgccgccccctttgctccgctccatggatgcggacaagaattaattaattattattccccattttgccgttcttgcttttttctgtattttctcggaaattgtccctttatgtacgtatacaaatttatatccagacaaataatattactcctataaaaaaaaaaaaaaaaaaaaaaaaaaaaa

SEQ ID NO: 100 - protein, 258 aa, Lolium perenne
MRPRRLMPRPRWPRSRPPLTAPSRSPATPRSATRACSRATRSTSTSWRPPCTRASTSASSSARTPPTTHGTSPRRRTRASSSTCSSSSSAQRRPWRSASTPATPSSPPRSPSQKTEPSWPWTSTARTTRPSASRASRRPASRTRSTSARAPRSRSWTRCSTTRPTTAPSTSSSSTPTRTTTSTTTSASSSSGSAASSATTTRSGTDPSCSPPTRPCASTSATTATSSSSSTRPSPPTTASRSASFPSATASRSAAAPS

SEQ ID NO: 101 - DNA, 1164 bp, Lolium perenne
gaattcactagtgattaagcagtggtaacaacgcagagtacgcggggaacgccaatcactcgagtcagcaaaacaacaacccaatcatcccgcccagatctcacgcggttccttcctccacctaaacaccggcaatggcgaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacgacaacacgctctggaacggatccgtcgtgctccccgacgacgtgcccatgcgcaagtacatccgctactaccgcgacttcgtcctcgtgctcaacaaggagctcgccgcagacgaccgcgtcgagatctgccagctccccgtcggagacggcatcaccctctgccgccgcgcaaagtgattgtctgattgatgacgctcgcgcgcgcgccgtcccctccgctccgcaccatggatgcggacaagaattaattaattattccccattttgcctttcttgctttcttctgtatcttcttggaaacaaatattgtccctttatgtacgtatatcaaatttatatccagacaaataatatttctcctataaaatgatgacccgatattttattgtcaaaaaaaaaaaaaaaaaaaaaaaaaaaaaaa

SEQ ID NO: 102 - protein, 261 aa, Lolium perenne
MATTAADATTTVPKEQTTTNGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDALLEDEANHGSFDFVFVDADKDNYLNYHQRLMKLVRVGGLIGYDNTLWNGSVVLPDDVPMRKYIRYYRDFVLVLNKELAADDRVEICQLPVGDGITLCRRAK

SEQ ID NO: 103 - DNA, 1163 bp, Lolium perenne
gaattcactagtgattaagcagtggtaacaacgcagagtacgcggggaacgccaatcactcgagtcagcaaaacaacaacccaatcatcccgcccagatctcacgcggttccttcctccacctaaacaccggcaatgcgaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacgacaacacgctctggaacggatccgtcgtgctccccgacgacgtgcccatgcgcaagtacatccgctactaccgcgacttcgtcctcgtgctcaacaaggagctcgccgcagacgaccgcgtcgagatctgccagctccccgtcggagacggcatcaccctctgccgccgcgcaaagtgattgtctgattgatgacgctcgcgcgcgcgccgtcccctccgctccgcaccatggatgcggacaagaattaattaattattccccattttgcctttcttgctttcttctgtatcttcttggaaacaaatattgtccctttatgtacgtatatcaaatttatatccagacaaataatatttctcctataaaatgatgacccgatattttattgtcaaaaaaaaaaaaaaaaaaaaaaaaaaaaaaa

SEQ ID NO: 104 - protein, 257 aa, Lolium perenne
MRPRRLMPRPRCPRSRPPPTAPSRSPATPRSDTRACSRATRSTSTSWRPPCTRASTSASSSARTPPTTHGTPRRRTRASSSTCSSSSSAPRRPWRSASTPATPSSPPRSPSPKTEPSWPWTSTARTTRPSASRASRRPASRTRSTSARAPRSRCSTRCSKTRPTTAPSTSSSSTPTRTTTSTTTSASSSSGSADSSATTTRSGTDPSCSPTTCPCASTSATTATSSSCSTRSSPQTTASRSASSPSETASPSAAAQS

SEQ ID NO: 105 - DNA, 1088 bp, Lolium perenne
gaattcgattaagcagtggtaacaacgcagagtacgcggggaccgaactcgtgttctctctctctctccgcgtgacgcttgttttgtgcatattgtagaacggtgcgagtcttgagcggcggcggcggttccttcttcgccgggctagcagcagcagtagcggcgcggccatggcttcgaacggggaggtcaaggacatccacaacagcgaaagcaccaagacgctcctcaagagtgacgccctctacgagtacatgctgaagtcgatggtgtacccacgggagaacgagttcctgcgggagctccgcctcatcaccaaggagcacacctatgggttcatgtcgtcgccgccggacgagggccagctgttgtcgctgttgctcaaggtgatgggcgccaagaagaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggcgtcgcgcacaaggtgggcttccgcgagggccccgccggcccgatcctcgacgggctcatcgccgacgaagaacacgaggcgagctttgacttcgccttcgtggacgccgacaagcccaactatggcaagtaccacgagcagctgctgcggctggtgcgtgtcggcggcgtgttcgcttacgacaacacgttttggggcggctcagtggccatgcccgacgccaccccgctcccggaggaggacatccaggtaagggaccccatgagggagttcaacccaaggatccccgccgatgcgcgtgtggagcccgtgcagctcccaatcgccgagggcatcacgctttgccgccgcgtcgcatgatcggggcttcatgggggggggactttttttttttggggcgggcgtttgatgtgtttatgcgatcaaataataagaggattgattgctgttgtttcgtttttcataatcgttcaggttagggagttgtcatttgatttgggggggctcaaaaaaaaaaaaaaaaaaaaaaaaaaaaaaaaaaaaaaa

SEQ ID NO: 106 - protein, 243 aa, Lolium perenne
MASNGEVKDIHNSESTKTLLKSDALYEYMLKSMVYPRENEFLRELRLITKEHTYGFMSSPPDEGQLLSLLLKVMGAKKTIEVGVFTGCSVLATALAIPDDGKVVAIDVSREYFDLGLPVIKKAGVAHKVGFREGPAGPILDGLIADEEHEASFDFAFVDADKPNYGKYHEQLLRLVRVGGVFAYDNTFWGGSVAMPDATPLPEEDIQVRDPMREFNPRIPADARVEPVQLPIAEGITLCRRVA

SEQ ID NO: 107 - DNA, 1087 bp, Lolium perenne
gaattcgattaagcagtggtaacaacgcagagtacgcggggaccgaactcgtgttctctctctctctccgcgtgacgcttgttttgtgcatattgtagaacggtgcgagtcttgagcggcggcggcggttccttcttcgccgggctagcagcagcagtagcggcgcggccatgcttcgaacggggaggtcaaggacatccacaacagcgaaagcaccaagacgctcctcaagagtgacgccctctacgagtacatgctgaagtcgatggtgtacccacgggagaacgagttcctgcgggagctccgcctcatcaccaaggagcacacctatgggttcatgtcgtcgccgccggacgagggccagctgttgtcgctgttgctcaaggtgatgggcgccaagaagaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggcgtcgcgcacaaggtgggcttccgcgagggccccgccggcccgatcctcgacgggctcatcgccgacgaagaacacgaggcgagctttgacttcgccttcgtggacgccgacaagcccaactatggcaagtaccacgagcagctgctgcggctggtgcgtgtcggcggcgtgttcgcttacgacaacacgttttggggcggctcagtggccatgcccgacgccaccccgctcccggaggaggacatccaggtaagggaccccatgagggagttcaacccaaggatccccgccgatgcgcgtgtggagcccgtgcagctcccaatcgccgagggcatcacgctttgccgccgcgtcgcatgatcggggcttcatgggggggggactttttttttttggggcgggcgtttgatgtgtttatgcgatcaaataataagaggattgattgctgttgtttcgtttttcataatcgttcaggttagggagttgtcatttgatttgggggggctcaaaaaaaaaaaaaaaaaaaaaaaaaaaaaaaaaaaaaaa

SEQ ID NO: 108 - protein, 239 aa, Lolium perenne
MLRTGRSRTSTTAKAPRRSSRVTPSTSTCSRWCTHGRTSSCGSSASSPRSTPMGSCRRRRTRASCCRCCSRWAPRRPSRSASSPAAPSSPRRSPSRTMARWSPSTSAGSTSTSASPSSRRPASRTRWASARAPPARSSTGSSPTKNTRRALTSPSWTPTSPTMASTTSSCCGWCVSAACSLTTTRFGAAQWPCPTPPRSRRRTSRGTPGSSTQGSPPMRVWSPCSSQSPRASRFAAASH

SEQ ID NO: 109 - DNA, 1214 bp, Lolium perenne
gaattcgattaagcagtggtaacaacgcagagtacgcgggacgggactcgtgttctctctctctctctgcgtgacgcttgttgtgtgcatattgtagaacggtgcgagtcttgagcggcggcggcggttccttcttcgccgggctagcagcagcagttgcggcgcggccatggcttcgaacggggaggtcaaggacatccacaacagcgaaagcaccaagacgctcctcaagagtgacgccctctacgagtacatgctgaagacgatggtgtacccacgggagaacgagttcctgcgggagctccgcctcatcaccaaggagcacacctatgggttcatgtcgtcgccgccggacgagggcctgctcctctcgctgctcctgaaggtcatgggcgccaagaacaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggagtcgcgcacaaggtcgagttccgcgagggccctgccggccccatcctcgatgggctcatcgccaacgaagaagacgaggggagcttcgacttcgcattcgtcgacgccgacaagcccaactacggcaagtaccacgagcagctgctgcggctggtgcgtgtcggcggcgtgctcgcctacgacaacacgctctggggcggctcagtggccatgcccgccgacacgccgctcacggaggacgacatccaggtaagggacgccatgagggagttcaacgcaaggatcgccgccgatgcgcgtgtggagcccgtgcagctcccaatcgccgatggcatcacgttttgccgccgcgtcgcatgatcgtggcttcatgaggcggtgagccggtgactttcgtttcttggggcgcgcgtttgatgtgtttatgcgatcaaataataagatgattgattgctgttgtatcgtttttcataatcgttcaggttatggagttgtcatttgatttgtggcggctcactcaatctttcgggtacccaatgacggcgggctataagtaaataaaaaatttggtacaagtacaatacatcatatgaccgagctgtacttttttaagtttgtttcaaatatggcaatgtgatactcgcaaaaaaaaaaaaaaaaaaaaaaaaaaaaa

SEQ ID NO: 110 - protein, 243 aa, Lolium perenne
MASNGEVKDIHNSESTKTLLKSDALYEYMLKTMVYPRENEFLRELRLITKEHTYGFMSSPPDEGLLLSLLLKVMGAKNTIEVGVFTGCSVLATALAIPDDGKVVAIDVSREYFDLGLPVIKKAGVAHKVEFREGPAGPILDGLIANEEDEGSFDFAFVDADKPNYGKYHEQLLRLVRVGGVLAYDNTLWGGSVAMPADTPLTEDDIQVRDAMREFNARIAADARVEPVQLPIADGITFCRRVA

SEQ ID NO: 111 - DNA, 1213 bp, Lolium perenne
gaattcgattaagcagtggtaacaacgcagagtacgcgggacgggactcgtgttctctctctctctctgcgtgacgcttgttgtgtgcatattgtagaacggtgcgagtcttgagcggcggcggcggttccttcttcgccgggctagcagcagcagttgcggcgcggccatgcttcgaacggggaggtcaaggacatccacaacagcgaaagcaccaagacgctcctcaagagtgacgccctctacgagtacatgctgaagacgatggtgtacccacgggagaacgagttcctgcgggagctccgcctcatcaccaaggagcacacctatgggttcatgtcgtcgccgccggacgagggcctgctcctctcgctgctcctgaaggtcatgggcgccaagaacaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggagtcgcgcacaaggtcgagttccgcgagggccctgccggccccatcctcgatgggctcatcgccaacgaagaagacgaggggagcttcgacttcgcattcgtcgacgccgacaagcccaactacggcaagtaccacgagcagctgctgcggctggtgcgtgtcggcggcgtgctcgcctacgacaacacgctctggggcggctcagtggccatgcccgccgacacgccgctcacggaggacgacatccaggtaagggacgccatgagggagttcaacgcaaggatcgccgccgatgcgcgtgtggagcccgtgcagctcccaatcgccgatggcatcacgttttgccgccgcgtcgcatgatcgtggcttcatgaggcggtgagccggtgactttcgtttcttggggcgcgcgtttgatgtgtttatgcgatcaaataataagatgattgattgctgttgtatcgtttttcataatcgttcaggttatggagttgtcatttgatttgtggcggctcactcaatctttcgggtacccaatgacggcgggctataagtaaataaaaaatttggtacaagtacaatacatcatatgaccgagctgtacttttttaagtttgtttcaaatatggcaatgtgatactcgcaaaaaaaaaaaaaaaaaaaaaaaaaaaaa

SEQ ID NO: 112 - protein, 239 aa, Lolium perenne
MLRTGRSRTSTTAKAPRRSSRVTPSTSTCRRWCTHGRTSSCGSSASSPRSTPMGSCRRRRTRACSSRCSRSWAPRTPSRSASSPAAPSSPRRSPSRTMARWSPSTSAGSTSTSASPSSRRPESRTRSSSARALPAPSSMGSSPTKKTRGASTSHSSTPTSPTTASTTSSCCGWCVSAACSPTTTRSGAAQWPCPPTRRSRRTTSRGTPGSSTQGSPPMRVWSPCSSQSPMASRFAAASH

SEQ ID NO: 113 - DNA, 1151 bp, Lolium perenne
gaattcactagtgattaagcagtggtaacaacgcagagtacgcgggggcaacgccaatcactcgagtcagcaaaacaacaacccaatcatcccgctcagatctcacgcgtttccttcctccagctaaacaccggcaatggcgacaacggcggctgatgccacggccacggttgccaaggagcagaccaccaccaacggcgccgccagcggtgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatcccagaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctccaggacgaggccaaccacggcaccttcgacttcgtcttcgtcgacgccgacaaggacaactacctcaactaccaccagcgcctcatgaagctcgtcagggtcggcggcctcctcggctacgacaacacgctctggaacggatccgtcgtgctccccgccgacgcgcccatgcgcaagtacatccgctactaccgcgacttcgtcctcgagctcaacaaggccctcgccgcagacgaccgcgtcgagatctgccagctccccgtcggagacggcatcaccctctgccgccgcgcaaagtgattgtttgattgatgacgcccgcgagcgcgccgccccctttggtccgctccatggatggggacaagaattaattaattattattcccccttttgccgttttggcttttttttgtatttttttggaaacaaatattgtccctttatgtacgtatatcaaatttatatcccgacaaataatattactcctaaaaaaaaaaaaaaaaaaaaaaaaaaaaaa

SEQ ID NO: 114 - protein, 265 aa, Lolium perenne
MATTAADATATVAKEQTTTNGAASGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDELLQDEANHGTFDFVFVDADKDNYLNYHQRLMKLVRVGGLLGYDNTLWNGSVVLPADAPMRKYIRYYRDFVLELNKALAADDRVEICQLPVGDGITLCRRAK

SEQ ID NO: 115 - DNA, 1150 bp, Lolium perenne
gaattcactagtgattaagcagtggtaacaacgcagagtacgcgggggcaacgccaatcactcgagtcagcaaaacaacaacccaatcatcccgctcagatctcacgcgtttccttcctccagctaaacaccggcaatgcgacaacggcggctgatgccacggccacggttgccaaggagcagaccaccaccaacggcgccgccagcggtgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatcccagaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctccaggacgaggccaaccacggcaccttcgacttcgtcttcgtcgacgccgacaaggacaactacctcaactaccaccagcgcctcatgaagctcgtcagggtcggcggcctcctcggctacgacaacacgctctggaacggatccgtcgtgctccccgccgacgcgcccatgcgcaagtacatccgctactaccgcgacttcgtcctcgagctcaacaaggccctcgccgcagacgaccgcgtcgagatctgccagctccccgtcggagacggcatcaccctctgccgccgcgcaaagtgattgtttgattgatgacgcccgcgagcgcgccgccccctttggtccgctccatggatggggacaagaattaattaattattattcccccttttgccgttttggcttttttttgtatttttttggaaacaaatattgtccctttatgtacgtatatcaaatttatatcccgacaaataatattactcctaaaaaaaaaaaaaaaaaaaaaaaaaaaaaa

SEQ ID NO: 116 - protein, 261 aa, Lolium perenne
MRQRRLMPRPRLPRSRPPPTAPPAVPSRSPATPRSDTRACSRATRSTSTSWRPPCTRASTSASSSARTPPTTHGTPRRRTRASSSTCSSSSSAPRRPWRSASTPATPSSPPRSPSQRTARSWPWTSTARTTRPSASRASRRPASRTRSTSARGPRSRCSTSCSRTRPTTAPSTSSSSTPTRTTTSTTTSASSSSGSAASSATTTRSGTDPSCSPPTRPCASTSATTATSSSSSTRPSPQTTASRSASSPSETASPSAAAQS

SEQ ID NO: 117 - DNA, 1236 bp, Festuca arundinacea
caagagctagttcttctgtccatccgtagctcttccctttcaccaacaagctagtttagacaagtacagtggtactgtaagagcaacaatgaccgttgtcgacgccgccgcgccgcagctgcctggccatgggcagaccgtgtgcgtcaccggcgccgcggggtacatcgcgtcggggctcgtcaagctgctcctggagagaggctacaccgtgaagggcacagtgaggaacccagatgatcccaagaacgcccacctgaaggcgctggacggcgccaccgagaggctgatcctctgcaaagccgacctcctcgactacgacgccatatgcgccgccgtcgagggctgccacggcgtgttccacaccgcctctccagtcaccgatgatcctgagcagatggtggagccggcggtgcggggcacggagtacgtgatcaacgcggcagcggatgcgggaacggtgcgccgggtggtgttcacgtcgtcaatcggtgccatcaccatggaccccaaccgcggtcctgacgtagtcgtcaatgagtcctgctggagcgacctcgaattctgcaagaaaaccaagaactggtactgctacggcaaggccgtggcggagcaggctgcgtgggaggcggccaggaagcgcggcatcgacctcgtcgtcgtgaaccctgtgctcgtggtagggccgctgctgcaaccaacggtgaacgctagcgccgcacacatcctcaagtacctcgacggctcggccaagaagtacgccaacgctgtgcagtcatacgtagacgtgcgtgacgtagccggcgcgcacatccgggtgttcgaggcgcctgaggcgtcgggccggtacctctgcgccgagcgcgtgctgcaccgtggggacgttgtccaaatcctcagcaaactcttccctgagtaccctgtgccaacaaggtgctctgatgaagtgaacccacggaagcagccttataagatgtccaaccagaagctgcaggatcttggcctccagttcactcctgtgaacgactctctgtatgagaccgtgaagagcctccaggagaagggacatctcctagtaccaagcaaaccagagggattaaacggtgtaacggcatgatactgctaaagaagcagcagagttcacgtgctcctgtaacatggtcaaacatgagttgtttttctgtataaattctatccagtatcgtgttatttaagtgaactaagagaaaaaaaaaa

SEQ ID NO: 118 - protein, 342 aa, Festuca arundinacea
MTVVDAAAPQLPGHGQTVCVTGAAGYIASGLVKLLLERGYTVKGTVRNPDDPKNAHLKALDGATERLILCKADLLDYDAICAAVEGCHGVFHTASPVTDDPEQMVEPAVRGTEYVINAAADAGTVRRVVFTSSIGAITMDPNRGPDVVVNESCWSDLEFCKKTKNWYCYGKAVAEQAAWEAARKRGIDLVVVNPVLVVGPLLQPTVNASAAHILKYLDGSAKKYANAVQSYVDVRDVAGAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKPEGLNGVTA

SEQ ID NO: 119 - DNA, 1231 bp, Festuca arundinacea
caagagctagttcttctgtccatccgtagctcttccctttcaccaacaagctagtttagacaagtacagtggtactgtaagagcaacaatgccgttgtcgacgccgccgcgccgcagctgcctggccatgggcagaccgtgtgcgtcaccggcgccgcggggtacatcgcgtcggggctcgtcaagctgctcctggagagaggctacaccgtgaagggcacagtgaggaacccagatgatcccaagaacgcccacctgaaggcgctggacggcgccaccgagaggctgatcctctgcaaagccgacctcctcgactacgacgccatatgcgccgccgtcgagggctgccacggcgtgttccacaccgcctctccagtcaccgatgatcctgagcagatggtggagccggcggtgcggggcacggagtacgtgatcaacgcggcagcggatgcgggaacggtgcgccgggtggtgttcacgtcgtcaatcggtgccatcaccatggaccccaaccgcggtcctgacgtagtcgtcaatgagtcctgctggagcgacctcgaattctgcaagaaaaccaagaactggtactgctacggcaaggccgtggcggagcaggctgcgtgggaggcggccaggaagcgcggcatcgacctcgtcgtcgtgaaccctgtgctcgtggtagggccgctgctgcaaccaacggtgaacgctagcgccgcacacatcctcaagtacctcgacggctcggccaagaagtacgccaacgctgtgcagtcatacgtagacgtgcgtgacgtagccggcgcgcacatccgggtgttcgaggcgcctgaggcgtcgggccggtacctctgcgccgagcgcgtgctgcaccgtggggacgttgtccaaatcctcagcaaactcttccctgagtaccctgtgccaacaaggtgctctgatgaagtgaacccacggaagcagccttataagatgtccaaccagaagctgcaggatcttggcctccagttcactcctgtgaacgactctctgtatgagaccgtgaagagcctccaggagaagggacatctcctagtaccaagcaaaccagagggattaaacggtgtaacggcatgatactgctaaagaagcagcagagttcacgtgctcctgtaacatggtcaaacatgagttgtttttctgtataaattctatccagtatcgtgttatttaagtgaactaagagaaaaaa

SEQ ID NO: 120 - protein, 240 aa, Festuca arundinacea
MPLSTPPRRSCLAMGRPCASPAPRGTSRRGSSSCSWREATPRAQGTQMIPRTPTRRWTAPPRGSSAKPTSSTTTPYAPPSRAATACSTPPLQSPMILSRWWSRRCGARSTSTRQRMRERCAGWCSRRQSVPSPWTPTAVLTSSMSPAGATSNSARKPRTGTATARPWRSRLRGRRPGSAASTSSSTLCSWGRCCNQRTLAPHTSSSTSTARPRSTPTLCSHTTCVTPARTSGCSRRLRRR

SEQ ID NO: 121 - DNA, 1332 bp, Lolium perenne
gacgaatcctaccaaaccgagctaccagatccttctctactaatcgagctccctccgcctgtcctcgtccccgcctcaccgccggccggttctccgctccgagctatacgtccgtccgagaacacccgtcccatattaactatcaacatgacagtcgtcgaggtcttagctgccggcgacgccgccgccgccgcggtggcgcggcccgccgggaacgggcagaccgtgtgtgtgaccggcgccgccgggtacatcgcgtcctggctcgtcaagctgctgctggagaaggggtacactgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcatccccagtcactgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgcaagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccacaaggtgctccgacgaggcgaacccgaggaagcagccatacaagatgtctaaccagaagctccaggacctcggactcgagttcaggccggtgagccagtccctgtacgagacggtgaagagcctccaggagaagggccaccttccggtgctcagcgagcaggcagaggcggacaaggaaaccctggctgcagagctgcaggcaggggttaccatccgagcatgaggaacaagaaatcaaccatgtccatactgctactgtcatgtaaaccaggcagtgtctgttgaatgcctaatctaagttcttgtaaaaaaaaaa

SEQ ID NO: 122 - protein, 363 aa, Lolium perenne
MTVVEVLAAGDAAAAAVARPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDEANPRKQPYKMSNQKLQDLGLEFRPVSQSLYETVKSLQEKGHLPVLSEQAEADKETLAAELQAGVTIRA

SEQ ID NO: 123 - DNA, 1324 bp, Lolium perenne
gacgaatcctaccaaaccgagctaccagatccttctctactaatcgagctccctccgcctgtcctcgtccccgcctcaccgccggccggttctccgctccgagctatacgtccgtccgagaacacccgtcccatattaactatcaacatgcagtcgtcgaggtcttagctgccggcgacgccgccgccgccgcggtggcgcggcccgccgggaacgggcagaccgtgtgtgtgaccggcgccgccgggtacatcgcgtcctggctcgtcaagctgctgctggagaaggggtacactgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcatccccagtcactgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgcaagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccacaaggtgctccgacgaggcgaacccgaggaagcagccatacaagatgtctaaccagaagctccaggacctcggactcgagttcaggccggtgagccagtccctgtacgagacggtgaagagcctccaggagaagggccaccttccggtgctcagcgagcaggcagaggcggacaaggaaaccctggctgcagagctgcaggcaggggttaccatccgagcatgaggaacaagaaatcaaccatgtccatactgctactgtcatgtaaaccaggcagtgtctgttgaatgcctaatctaagttcttgtaaa

SEQ ID NO: 124 - protein, 195 aa, Lolium perenne
MQSSRSLPATPPPPRWRGPPGTGRPCVPAPPGTSRPGSSSCCWRRGTLSRAPSGTQTTRRTRTGRSTAPPTGWSSARPTSSTTTPSAAPSTAATASSTPHPQSLTTPSKWWSRRGARSTSTRRRRPARCGGWCSPPPSAPSPWTPTAGRTWSSTSRAGATSTSARKPGTGTATGRRLRSRRHRSWRGSAAWTLWW

SEQ ID NO: 125 - DNA, 1395 bp, Lolium perenne; identical to SEQ ID NO: 7

SEQ ID NO: 126 - protein, 362 aa, Lolium perenne; identical to SEQ ID NO: 8

SEQ ID NO: 127 - DNA, 1394 bp, Lolium perenne
ggcacgaggaatcctaccaaaccgagctaccagatccttctctactaatcgagctccctacgctgctccgcctgtcttcgtttccgcctcaccgccggccggttctccgctccaagctacgtccgtccgtccacatatatagcatcgacatgccatcgccgaggtcgtggctgccggagacaccgccgccgcggtggtgcagcccgccgggaacgggcagaccgtgtgcgtgaccggcgccgccgggtacatcgcgtcgtggctcgtcaagctgctgctggagaaggggtacaccgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcgtcccccgtcaccgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgccagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccaccaggtgctctgatgagacgaacccgaggaagcagccatacaagatgtcgaaccagaagctccaggacctcggactcgagttcaggccggtgagccagtccctgtacgagacggtgaagagcctccaggagaagggccaccttccggtgctcagcgagcaggcagaggcggacaaggaaaccctagctgccgagctgcaggcaggggttaccatccgagcatgaggaacaagaaatcaaccatgtccatactgctactgtcatgtaaaccagctgttgaatgcctaaaatctaagttcttgtaatactgtgttgtttcatgtggactagattgatcgaataaacatctctacacaaggttgctaaaaaaaaaaaaaaaaaa

SEQ ID NO: 128 - protein, 352 aa, Lolium perenne
MPSPRSWLPETPPPRWCSPPGTGRPCAPAPPGTSRRGSSSCCWRRGTPSRAPSGTQTTRRTRTGRSTAPPTGWSSARPTSSTTTPSAAPSTAATASSTPRPPSPTTPSKWWSRRGARSTSTRRRRPARCGGWCSPPPSAPSPWTPTAGRTWSSTSRAGATSTSARKPGTGTATGRRLRSRRHRSWRGSAAWTLWWTRCWSAPCCSRRTPASATSSSTWTGRPASSPTPCRRTWTSATWPTPTSASSSAPPRPAATSAPSASSTARTSCASSPSSSPSTPSPPGALMRRTRGSSHTRCRTRSSRTSDSSSGRASPCTRRRASRRRATFRCSASRQRRTRKPLPSCRQGLPSEH

SEQ ID NO: 129 - DNA, 1207 bp, Lolium perenne
atgactgttgtcaacaccgtcgcgcagcaactgcctggccatgggcagaccgtgtgtgtcaccggcgctgccggatacatcgcgtcttggctcgtcaagctgctcctggagagaggctacaccgtgaagggcacagtgaggaacccagatgatcccaagaacgctcacctgaaggcgctggacggcgccgtcgagaggctgatcctctgcaaagccgacctcctcgactatgatgccatatgcgccgccgccgagggctgccatggcgtgttccacaccgcctctccggtcaccgatgatcctgagcagatggtggagccggcggtgcggggcacggagtacgtgatcaacgcagcggcggatgcaggaacggtgcgccgggtggtgttcacgtcgtccatcggcgccgtcaccatggaccccaaccgcggtcctgacgtagttgtcgacgagtcctgctggagcgacctcgaattctgcaagaagaccaagaactggtactgctacggcaaggcggtggcggagcaggctgcgtgggaggcagccaggaagcgtggcatcgacctcgttgtcgtgaaccctgtgctcgtggtcgggccactgctgcagccaacggtgaacgctagcgccgcacacatcctcaagtacctcgacggctcggccaagaagtatgccaacgccgtgcagtcatacgtggacgtgcgtgatgtagccgacgcgcacatccgcgtgttcgaggcgcccgaggcctcgggccggtacctctgcgccgagcgcgtgctgcaccgtggggacgttgtccaaatcctcagcaaactcttccctgagtaccctgtgccaacaaggtgctctgacgaagtgaacccacggaagcagccttataagatgtccaaccagaagctgcaggatcttggcctccagttcactcctgtgaacgactctctgtatgagaccgtgaagagcctccaggagaagggacacctcctagtaccaagcaaaaatataccagagggattgaacggtgtaacggcatgatgctgctaaagaagcagcggagttcacatgctcctgtaacatggtgaaacatcagttgtttttctgtataaattctatccagtatcgtgttatttaagtgaactaagagaacagaatattgtatcatcttcgatgtccaacacctggaagggatttttttttgcaacctatc

SEQ ID NO: 130 - protein, 344 aa, Lolium perenne
MTVVNTVAQQLPGHGQTVCVTGAAGYIASWLVKLLLERGYTVKGTVRNPDDPKNAHLKALDGAVERLILCKADLLDYDAICAAAEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEAARKRGIDLVVVNPVLVVGPLLQPTVNASAAHILKYLDGSAKKYANAVQSYVDVRDVADAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKNIPEGLNGVTA

SEQ ID NO: 131 - DNA, 1206 bp, Lolium perenne
atgctgttgtcaacaccgtcgcgcagcaactgcctggccatgggcagaccgtgtgtgtcaccggcgctgccggatacatcgcgtcttggctcgtcaagctgctcctggagagaggctacaccgtgaagggcacagtgaggaacccagatgatcccaagaacgctcacctgaaggcgctggacggcgccgtcgagaggctgatcctctgcaaagccgacctcctcgactatgatgccatatgcgccgccgccgagggctgccatggcgtgttccacaccgcctctccggtcaccgatgatcctgagcagatggtggagccggcggtgcggggcacggagtacgtgatcaacgcagcggcggatgcaggaacggtgcgccgggtggtgttcacgtcgtccatcggcgccgtcaccatggaccccaaccgcggtcctgacgtagttgtcgacgagtcctgctggagcgacctcgaattctgcaagaagaccaagaactggtactgctacggcaaggcggtggcggagcaggctgcgtgggaggcagccaggaagcgtggcatcgacctcgttgtcgtgaaccctgtgctcgtggtcgggccactgctgcagccaacggtgaacgctagcgccgcacacatcctcaagtacctcgacggctcggccaagaagtatgccaacgccgtgcagtcatacgtggacgtgcgtgatgtagccgacgcgcacatccgcgtgttcgaggcgcccgaggcctcgggccggtacctctgcgccgagcgcgtgctgcaccgtggggacgttgtccaaatcctcagcaaactcttccctgagtaccctgtgccaacaaggtgctctgacgaagtgaacccacggaagcagccttataagatgtccaaccagaagctgcaggatcttggcctccagttcactcctgtgaacgactctctgtatgagaccgtgaagagcctccaggagaagggacacctcctagtaccaagcaaaaatataccagagggattgaacggtgtaacggcatgatgctgctaaagaagcagcggagttcacatgctcctgtaacatggtgaaacatcagttgtttttctgtataaattctatccagtatcgtgttatttaagtgaactaagagaacagaatattgtatcatcttcgatgtccaacacctggaagggatttttttttgcaacctatc

SEQ ID NO: 132 - protein, 329 aa, Lolium perenne
MLLSTPSRSNCLAMGRPCVSPALPDTSRLGSSSCSWREATPRAQGTQMIPRTLTRRWTAPSRGSSAKPTSSTMMPYAPPPRAAMACSTPPLRSPMILSRWWSRRCGARSTSTQRRMQERCAGWCSRRPSAPSPWTPTAVLTLSTSPAGATSNSARRPRTGTATARRWRSRLRGRQPGSVASTSLSTLCSWSGHCCSQRTLAPHTSSSTSTARPRSMPTPCSHTWTCVMPTRTSACSRRPRPRAGTSAPSACCTVGTLSKSSANSSLSTLCQQGALTKTHGSSLIRCPTRSCRILASSSLLTTLCMRPRASRRRDTSYQAKIYQRDTVRH

SEQ ID NO: 133 - DNA, 1428 bp, Festuca arundinacea
ctctcgatcggcagacgcagagatcgatgggttccaccgccgccgacatggccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcgccggacatggtggaccgcatgctccggctgctcgcgtcgtacaacgtcgtgacgtgcctggtagaggagggcaaggacgggcgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatccccttcaacaaggcgtacggcatgtcggcgttcgagtaccacggcacggacccgcgcttcaaccgcgttttcaacgaagggatgaagaaccactccatcatcatcaccaagaagctcctcgagctctaccacggcttccagggcctcggcaccctcgtcgacgtcggcggcggcgtcggcgccaccgtggccgccatcgccgcccactaccccgccatcaagggggtcaacttcgacctcccccacgtcatctccgaggcgccgcagttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaagcccagctcgcagggggtcttccacgtcgacatgatcatgctcgcgcacaaccccggcggcagggagaggtacgagagggagttcgaggccctggccaggggagctgggttcaccggcgtcaagtccacgtacatctacgcaaacgcgtgggccatcgagttcaccaagtagatgagatccctccggcctccatgcatccaggcaacctcccaccgatatgagaacgatcgtcgtcgatcttgctggctgctgcctctgctcctgcatcgatctgcatacgtaccctttgcttggtttttcctctgttttccctaattttctcatgctctgaattctgaattctgatggctgtgtcgtcgatctgctcggaaatgttctgaaaaggttgcgtatgttgtatacttgtatgtgatgtaatgagatgatttctctcctttgttgaatactcgagtaaattgaagtgactctcatcttcctctgaaaaaaaaaa

SEQ ID NO: 134 - protein, 360 aa, Festuca arundinacea
MGSTAADMAASADEEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 135 - DNA, 1420 bp, Festuca arundinacea
ctctcgatcggcagacgcagagatcgatggttccaccgccgccgacatggccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcgccggacatggtggaccgcatgctccggctgctcgcgtcgtacaacgtcgtgacgtgcctggtagaggagggcaaggacgggcgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatccccttcaacaaggcgtacggcatgtcggcgttcgagtaccacggcacggacccgcgcttcaaccgcgttttcaacgaagggatgaagaaccactccatcatcatcaccaagaagctcctcgagctctaccacggcttccagggcctcggcaccctcgtcgacgtcggcggcggcgtcggcgccaccgtggccgccatcgccgcccactaccccgccatcaagggggtcaacttcgacctcccccacgtcatctccgaggcgccgcagttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaagcccagctcgcagggggtcttccacgtcgacatgatcatgctcgcgcacaaccccggcggcagggagaggtacgagagggagttcgaggccctggccaggggagctgggttcaccggcgtcaagtccacgtacatctacgcaaacgcgtgggccatcgagttcaccaagtagatgagatccctccggcctccatgcatccaggcaacctcccaccgatatgagaacgatcgtcgtcgatcttgctggctgctgcctctgctcctgcatcgatctgcatacgtaccctttgcttggtttttcctctgttttccctaattttctcatgctctgaattctgaattctgatggctgtgtcgtcgatctgctcggaaatgttctgaaaaggttgcgtatgttgtatacttgtatgtgatgtaatgagatgatttctctcctttgttgaatactcgagtaaattgaagtgactctcatcttcctctgaaa

SEQ ID NO: 136 - protein, 245 aa, Festuca arundinacea
MVPPPPTWPRPPTRRRACSPSSSPPRRSSRRRTPSSLASWRSWWPPAASRPPPRWPPSSRPRRTRKRRTWWTACSGCSRRTTSRAWRRARTGASPGATAPRPCASSSPPTRTASPWRRSRSTRTRSSWRAGTTSRTRSLTAASPSTRRTACRRSSTTARTRASTAFSTKGRTTPSSSPRSSSSSTTASRASAPSSTSAAASAPPWPPSPPTTPPSRGSTSTSPTSSPRRRSSRASPTSAATCSRR

SEQ ID NO: 137 - DNA, 1452 bp, Festuca arundinacea
gctcgctcacaccaaaatcacccaccagcaccagcatctctcgatcggcagaggcagagatcgatgggctccaccgccgccgacatgaccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcaccggacatggtggaccgcatgctccggctgctggcgtcgtacaacgttgtgtcgtgcctggtggaggagggcaaggacggccgcctctcccggaactacggcgccgcgcccgtgtgcaagttcctcacccccaacgaggacggcgtctccatggcggcgctcgcgctcatgaaccaggacaaggtcctcatggagagctggtactatctgaaggacgcggtccttgacggcggcatcccgttcaacaaggcgtacggcatgtcggcgttcgagtaccacggaacggacccgcgcttcaaccgcgtgttcaacgaagggatgaagaaccactccatcatcatcaccaagaagctcctcgagctctacgacggcttccagggactcggcaccctcgtcgacgttggcggcggcgtcggcgccaccgtggccgccatcaccgcccactaccccgccatcaagggggtcaacttcgacctcccccacgtcatctccgaggcgccgccgttcccgggcgtcacccacgtcggcggcgacatgttcaagaaggtgccctcgggcgacgccatcatgatgaagtggatcctccacgactggagcgaccagcactgcgcaacgctgctcaagaactgctacgacgcgctgccggcgcacggcaaggtggtgctggtggagtgcatcctgccggtgaacccggaggccaagcccagctcgcagggggtgttccacgtcgacatgatcatgctcgcgcacaaccccggcggcagggagaggtacgagagggagttcgaggccctcgccaggggagctgggttcgctggcgtcaagtccacatacatctacgccaacgcctgggccatcgagttcaccaagtagatgagatccctccatccaggcaacctcccaccgaaatgagaatcgtgggtattcgatcttgctggctgctgccgctgctcctgcatcgatctgcatacgtaccctttgcttggtttttcctctgttttccgtaattttctcatgctctgaatccattctgaattctaatggttgtgtcgtcgatctgctcggaatgtaccattaataatgctgttctgaaaaggttgcatatgttgtatatgatgtaatggcatgatttctctcctttgttgaatataccagtacattgaagtgtcaaaaaaaaaa

SEQ ID NO: 138 - protein, 360 aa, Festuca arundinacea
MGSTAADMTASADEEACMFALQLASSSILPMTLKNAIELGLLEILVAAGGKSLTPTEVAAKLPSAANPEAPDMVDRMLRLLASYNVVSCLVEEGKDGRLSRNYGAAPVCKFLTPNEDGVSMAALALMNQDKVLMESWYYLKDAVLDGGIPFNKAYGMSAFEYHGTDPRFNRVFNEGMKNHSIIITKKLLELYDGFQGLGTLVDVGGGVGATVAAITAHYPAIKGVNFDLPHVISEAPPFPGVTHVGGDMFKKVPSGDAIMMKWILHDWSDQHCATLLKNCYDALPAHGKVVLVECILPVNPEAKPSSQGVFHVDMIMLAHNPGGRERYEREFEALARGAGFAGVKSTYIYANAWAIEFTK

SEQ ID NO: 139 - DNA, 1442 bp, Festuca arundinacea
gctcgctcacaccaaaatcacccaccagcaccagcatctctcgatcggcagaggcagagatcgatggctccaccgccgccgacatgaccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcaccggacatggtggaccgcatgctccggctgctggcgtcgtacaacgttgtgtcgtgcctggtggaggagggcaaggacggccgcctctcccggaactacggcgccgcgcccgtgtgcaagttcctcacccccaacgaggacggcgtctccatggcggcgctcgcgctcatgaaccaggacaaggtcctcatggagagctggtactatctgaaggacgcggtccttgacggcggcatcccgttcaacaaggcgtacggcatgtcggcgttcgagtaccacggaacggacccgcgcttcaaccgcgtgttcaacgaagggatgaagaaccactccatcatcatcaccaagaagctcctcgagctctacgacggcttccagggactcggcaccctcgtcgacgttggcggcggcgtcggcgccaccgtggccgccatcaccgcccactaccccgccatcaagggggtcaacttcgacctcccccacgtcatctccgaggcgccgccgttcccgggcgtcacccacgtcggcggcgacatgttcaagaaggtgccctcgggcgacgccatcatgatgaagtggatcctccacgactggagcgaccagcactgcgcaacgctgctcaagaactgctacgacgcgctgccggcgcacggcaaggtggtgctggtggagtgcatcctgccggtgaacccggaggccaagcccagctcgcagggggtgttccacgtcgacatgatcatgctcgcgcacaaccccggcggcagggagaggtacgagagggagttcgaggccctcgccaggggagctgggttcgctggcgtcaagtccacatacatctacgccaacgcctgggccatcgagttcaccaagtagatgagatccctccatccaggcaacctcccaccgaaatgagaatcgtgggtattcgatcttgctggctgctgccgctgctcctgcatcgatctgcatacgtaccctttgcttggtttttcctctgttttccgtaattttctcatgctctgaatccattctgaattctaatggttgtgtcgtcgatctgctcggaatgtaccattaataatgctgttctgaaaaggttgcatatgttgtatatgatgtaatggcatgatttctctcctttgttgaatataccagtacattgaagtgtca

SEQ ID NO: 140 - protein, 150 aa, Festuca arundinacea
MAPPPPTPRPPTRRRACSPSSSPPRRSSRRRTPSSLASWRSWWPPAASRPPPRWPPSSRPRRTRKHRTWWTACSGCWRRTTLCRAWWRRARTAASPGTTAPRPCASSSPPTRTASPWRRSRSTRTRSSWRAGTIRTRSLTAASRSTRRTA

SEQ ID NO: 141 - DNA, 1455 bp, Lolium perenne
ctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttgttgaatatacgagtaaattgaagtgaaaaaaaaaa

SEQ ID NO: 142 - protein, 360 aa, Lolium perenne
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 143 - DNA, 1444 bp, Lolium perenne
ctctcgctcacaccaaaatcgcccaccagcaccagcatctctcgatcggcagacgcatagatcgatggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttgttgaatatacgagtaaattgaagtg

SEQ ID NO: 144 - protein, 443 aa, Lolium perenne
MAPPPPTWPRPPTRTRACSPSSSLPRRSSRRRTPSSLASWRSWWPPAASRPRPRWPPSSRPRRTRKRRTWWTAYSGCSRRTTSRAWWRRARTAASPGATAPRPCASSSPPTRTASPWRRSRSTRTRSSWRAGTTSRTRSLTAASRSTRPTACRRSSTTARTRASTASSTKGRTTPSSSPRSSSSSTTASRVSAASSTSAAASAPPWPPPPTTPPSRGSTSTSPTSSPRRRSSRASPTSVATCSRRCPRETPSSSGSSTTGATSTAPRCSRTATTRCRRTARSCSSSASCRSTRRPIPARRGSSTSTSCSRTTPAAGRGTRGSSRLSPGEPDSPASSPRTSTPTRGPSSSPSRDPSKHPGNMSHRYENDRRRSCWLLPLLLHRSPFAWFFLCFPFSHALNPFILMVVSPICSECTINNDVLKRLRMLYTCMCNEMISLLCIYEI

SEQ ID NO: 145 - DNA, 1440 bp, Lolium perenne
gctcgggtctctcgctcatactaccaaaaacacccagcagcacaccagcgtctctcggcccaggagaagcagacacaggcagagatgggctccaccgcagccgaaattgccgcgtccgccgacgaggaggcgtgcttgtacgccctccagctcggctcgtcgtcgatcctcccaatgacgctgaagaacaccatcgagcttggcctcctggagaccctcatggccgccggcgggaagtcgctgacccccaccgaggtggccgcaaagctcccgtgcgcagcgaagaacccggaagcaccagacatggtggaccgcatgctccggctgctggcgtcgtacaacttagtgtcgtgccttgtggaggagggtacggatggccgcctctcccggcggtacggcgccgcgccggtgtgcaagttcctcacccccaacgaggacggcgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacctgcgcttcaaccgcgtgttcaacgaagcgatgaagaacaattccatcatcatcaccaagaagctcctccagctctacgacggcttccagggcctcggcaccctcgtcgatgtcggcggcggcgtcggcgccaccgtggccgccatcaccgcacactaccccaccatcaaggggatcaacttcgacctcccccacgtcatctccgaggcgccgccattcccgggcgtcacccacatcggcggcgacatgttcaagaaggtgccctcgggtgacgccatcctgatgaagtggatcctccacgactggagtgaccagcattgcgccacgctgctcaagaactgctacgacgcgctgccagtgcacggtaaggtggtgctggtggagtgcatcctgccggtgaacccggaggccaagcccagctcgcagggggtgttccacgtcgacatgatcatgctcgcgcacaacccaggcggcagggagaggtatgagagggagtacgaggcgctcgccaggggagctggcttcgccggcttcaagtccacatacatctacgccaacgcctgggccatcgagttcaccaagtagacgagaatcatgggtcttcgatcttgctggatgctgctgctgctccttcggtcaatctgcatgtgtaccctttgcttggtatttcctctgttttccataattttctcatgctctgaatctattccgaattctgatggctgtcgtcgatctgctcggaatgtaccattaataacgctgttcggtaaaggttgcatacagtatgttgtatgtgatgtaatgagatgatttatcccctttgttgaataaataaatttaagcttaaaaaaaaaa

SEQ ID NO: 146 - protein, 361 aa, Lolium perenne
MGSTAAEIAASADEEACLYALQLGSSSILPMTLKNTIELGLLETLMAAGGKSLTPTEVAAKLPCAAKNPEAPDMVDRMLRLLASYNLVSCLVEEGTDGRLSRRYGAAPVCKFLTPNEDGVSMAALALMNQDKVLMESWYYLKDAVLDGGIPFNKAYGMSAFEYHGTDLRFNRVFNEAMKNNSIIITKKLLQLYDGFQGLGTLVDVGGGVGATVAAITAHYPTIKGINFDLPHVISEAPPFPGVTHIGGDMFKKVPSGDAILMKWILHDWSDQHCATLLKNCYDALPVHGKVVLVECILPVNPEAKPSSQGVFHVDMIMLAHNPGGRERYEREYEALARGAGFAGFKSTYIYANAWAIEFTK

SEQ ID NO: 147 - DNA, 1432 bp, Lolium perenne
gctcgggtctctcgctcatactaccaaaaacacccagcagcacaccagcgtctctcggcccaggagaagcagacacaggcagagatggctccaccgcagccgaaattgccgcgtccgccgacgaggaggcgtgcttgtacgccctccagctcggctcgtcgtcgatcctcccaatgacgctgaagaacaccatcgagcttggcctcctggagaccctcatggccgccggcgggaagtcgctgacccccaccgaggtggccgcaaagctcccgtgcgcagcgaagaacccggaagcaccagacatggtggaccgcatgctccggctgctggcgtcgtacaacttagtgtcgtgccttgtggaggagggtacggatggccgcctctcccggcggtacggcgccgcgccggtgtgcaagttcctcacccccaacgaggacggcgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacctgcgcttcaaccgcgtgttcaacgaagcgatgaagaacaattccatcatcatcaccaagaagctcctccagctctacgacggcttccagggcctcggcaccctcgtcgatgtcggcggcggcgtcggcgccaccgtggccgccatcaccgcacactaccccaccatcaaggggatcaacttcgacctcccccacgtcatctccgaggcgccgccattcccgggcgtcacccacatcggcggcgacatgttcaagaaggtgccctcgggtgacgccatcctgatgaagtggatcctccacgactggagtgaccagcattgcgccacgctgctcaagaactgctacgacgcgctgccagtgcacggtaaggtggtgctggtggagtgcatcctgccggtgaacccggaggccaagcccagctcgcagggggtgttccacgtcgacatgatcatgctcgcgcacaacccaggcggcagggagaggtatgagagggagtacgaggcgctcgccaggggagctggcttcgccggcttcaagtccacatacatctacgccaacgcctgggccatcgagttcaccaagtagacgagaatcatgggtcttcgatcttgctggatgctgctgctgctccttcggtcaatctgcatgtgtaccctttgcttggtatttcctctgttttccataattttctcatgctctgaatctattccgaattctgatggctgtcgtcgatctgctcggaatgtaccattaataacgctgttcggtaaaggttgcatacagtatgttgtatgtgatgtaatgagatgatttatcccctttgttgaataaataaatttaagcttaaa

SEQ ID NO: 148 - protein, 430 aa, Lolium perenne
MAPPQPKLPRPPTRRRACTPSSSARRRSSQRRTPSSLASWRPSWPPAGSRPPPRWPQSSRAQRRTRKHQTWWTACSGCWRRTTCRALWRRVRMAASPGGTAPRRCASSSPPTRTASPWRRSRSTRTRSSWRAGTTRTRSLTAASRSTRRTACRRSSTTAQTCASTACSTKRRTIPSSSPRSSSSSTTASRASAPSSMSAAASAPPWPPSPHTTPPSRGSTSTSPTSSPRRRHSRASPTSAATCSRRCPRVTPSSGSSTTGVTSIAPRCSRTATTRCQCTVRWCWWSASCRTRRPSPARRGCSTSTSCSRTTQAAGRGMRGSTRRSPGELASPASSPHTSTPTPGPSSSPSRRESWVFDLAGCCCCSFGQSACVPFAWYFLCFPFSHALNLFRILMAVVDLLGMYHRCSVKVAYSMLYVMDDLSPLLNKIA

SEQ ID NO: 149 - DNA, 1438 bp, Festuca arundinacea
tcgctcacaccaaaatcacccaccagcaccagcatctcccgatcggcagaggcagagatcgatgggctccaccgccgccgacatggccgcgtccgccgacgaggaggcgtgcatgttcgccctccagctcgcctcctcgtcgatcctcccgatgaccctgaagaacgccatcgagcttggcctcctggagatcctggtagccgccggcggcaagtcgctgacccccaccgaggtggccgccaagctcccgtccgcggcgaacccggaagcaccggacatggtggaccgcatgctccggctgctggcgtcgtacaacgtcgtgtcgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcgtacggcatgtcggcgttcgagtaccacggcacggacccgcgcttcaaccgcgtcttcaacgaagggatgaagaaccactccatcatcatcaccaagaagctcctcgagctctaccacggcttccagggcctcggcaccctcgtcgacgtcggcggcggcgtcggcgccaccgtggctgccatcacggcgcactaccccgccatcaagggggtcaacttcgatctcccccacgtcatctccgaggcgccgccgttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtggtgctcgtcgagtgcatcctgccggtgaacccggaggccaagcccagctcgcagggggtgttccacgtcgacatgatcatgctcgcgcacaaccccggcggcagggagaggtacgaaagggagttcgaggcgctcgccaggggagccggcttcaccggcgtcaagtccacgtacatctacgccaacgcgtgggccatcgagttcaccaagtagatgagatccctccatgcatccaggcaacatgtcccaccgatatgagaaagatcgtcgtcgatcttgctggctgctgccgctgctcctgcatcgatctgcatacgtaccctttgcttggtttttcctctgttttccgtaattttctcatgttctgaatccattctgaattctaatggttgtgtcgtcgatctgctcggagtgtaccattaataacgctcttctgaaaaggttgcatatgttgtatgtgatgtaatgagatgatttctctcctttgttaaaaaaaaaaaaaaaaaa

SEQ ID NO: 150 - protein, 360 aa, Festuca arundinacea
MGSTAADMAASADEEACMFALQLASSSILPMTLKNAIELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 151 - DNA, 1437 bp, Festuca arundinacea
tcgctcacaccaaaatcacccaccagcaccagcatctcccgatcggcagaggcagagatcgatggctccaccgccgccgacatggccgcgtccgccgacgaggaggcgtgcatgttcgccctccagctcgcctcctcgtcgatcctcccgatgaccctgaagaacgccatcgagcttggcctcctggagatcctggtagccgccggcggcaagtcgctgacccccaccgaggtggccgccaagctcccgtccgcggcgaacccggaagcaccggacatggtggaccgcatgctccggctgctggcgtcgtacaacgtcgtgtcgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcgtacggcatgtcggcgttcgagtaccacggcacggacccgcgcttcaaccgcgtcttcaacgaagggatgaagaaccactccatcatcatcaccaagaagctcctcgagctctaccacggcttccagggcctcggcaccctcgtcgacgtcggcggcggcgtcggcgccaccgtggctgccatcacggcgcactaccccgccatcaagggggtcaacttcgatctcccccacgtcatctccgaggcgccgccgttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtggtgctcgtcgagtgcatcctgccggtgaacccggaggccaagcccagctcgcagggggtgttccacgtcgacatgatcatgctcgcgcacaaccccggcggcagggagaggtacgaaagggagttcgaggcgctcgccaggggagccggcttcaccggcgtcaagtccacgtacatctacgccaacgcgtgggccatcgagttcaccaagtagatgagatccctccatgcatccaggcaacatgtcccaccgatatgagaaagatcgtcgtcgatcttgctggctgctgccgctgctcctgcatcgatctgcatacgtaccctttgcttggtttttcctctgttttccgtaattttctcatgttctgaatccattctgaattctaatggttgtgtcgtcgatctgctcggagtgtaccattaataacgctcttctgaaaaggttgcatatgttgtatgtgatgtaatgagatgatttctctcctttgttaaaaaaaaaaaaaaaaaa

SEQ ID NO: 152 - protein, 351 aa, Festuca arundinacea
MAPPPPTWPRPPTRRRACSPSSSPPRRSSRPRTPSSLASWRSWPPAASRPPPRWPPSSRPRRTRKHRTWWTACSGCWRRTTSCRAWWRRARTAASPGATAPRPCASSSPPTRTASPWRRSRSTRTRSSWRAGTTSRTRSLTAASRSTRRTACRRSSTTARTRASTASSTKGRTTPSSSPRSSSSSTTASRASAPSSTSAAASAPPWLPSRRTTPPSRGSTSISPTSSPRRRRSRASPTSAATCSRRCPRATPSSSGSSTTGATSTAPRCSRTATTRCRRTARWCSSSASCRTRRPSPARRGCSTSTSCSRTTPAAGRGTKGSSRRSPGEPASPASSPRTSTPTRGPSSSPS

SEQ ID NO: 153 - DNA, 1430 bp, Festuca arundinacea
tcgggtctctcgctcacaccaaaaacacccagcagcactagcgtctctcggcccaggagaagcagacacaggcagagatgggctccagcgcagccgacgttgccgcgtccgccgacgaggaggcgtgcatgtacgccctccagctcggctcgtcgtcgatcctcccaatgacgctgaagaacaccatcgagcttggcctcctggagaccctgatggccgccggcgggaagtcgctgacccccaccgaggtggccgccaagctcccgtgcgcggcgaacccggaagcaccggacatggtggaccgcatgctccggctgctggcgtcgtacaacgtagtgtcgtgccttgtggaggagggtacggacggccgcctctcccggcggtacggcgccgcgccggtgtgcaagttcctcacccccaacgaggacggcgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacccgcgattcaaccgcgtgttcaacgaagcgatgaagaacaactccatcatcatcaccaagaagctcctcgagctctacgacggcttccagggcatcggcaccctcgtcgacgtcggcggcagcgtcggcgccaccgtggccgccatcaccgcccactaccccgccatcgaggggatcaacttcgacctcccccatgtcatctccgaggcgccgccgttcccgggcgtcacccacgtcggcggcgacatgttcaagaaggtgccctcgggcgacgccatcctgatgaagtggatcctccacgactggagcgaccagcattgcgccacgctgctcaagaactgctacgacgcgctgccagcgcacggcaaggtggtactggtggagtgcatcctgccggtgcacccggaggccaagcccagctcgcagggggtgttccacgtcgacatgatcatgctcgcgcacaaccccggtggcagggagaggtacgagagggagttcgaggcgctcgccaagggagctggcttcgccggcttcaagtccacatacatctacgccaacgcctgggccatcgagttcaccaagtagatgagaatcgtgggtcttcgatcttgctggatgctgctgctgctcctgcggtcgatctgcatgtgtaccctttgcttggtttttcctctgttttccacaattttctcatgctctgaatctagtctgaattctgatggctgtgtcgtgaatctgctcggaatgtaccattaataacgctgttctgaaaaggttgcatatgttgtatgtgatgtaatgagatgatttctatcctttgttgaataaataaattgaagtgtctcaaaaaaaaaa

SEQ ID NO: 154 - protein, 360 aa, Festuca arundinacea
MGSSAADVAASADEEACMYALQLGSSSILPMTLKNTIELGLLETLMAAGGKSLTPTEVAAKLPCAANPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLELYDGFQGIGTLVDVGGSVGATVAAITAHYPAIEGINFDLPHVISEAPPFPGVTHVGGDMFKKVPSGDAILMKWILHDWSDQHCATLLKNCYDALPAHGKVVLVECILPVHPEAKPSSQGVFHVDMIMLAHNPGGRERYEREFEALAKGAGFAGFKSTYIYANAWAIEFTK

SEQ ID NO: 155 - DNA, 1429 bp, Festuca arundinacea
tcgggtctctcgctcacaccaaaaacacccagcagcactagcgtctctcggcccaggagaagcagacacaggcagagatggctccagcgcagccgacgttgccgcgtccgccgacgaggaggcgtgcatgtacgccctccagctcggctcgtcgtcgatcctcccaatgacgctgaagaacaccatcgagcttggcctcctggagaccctgatggccgccggcgggaagtcgctgacccccaccgaggtggccgccaagctcccgtgcgcggcgaacccggaagcaccggacatggtggaccgcatgctccggctgctggcgtcgtacaacgtagtgtcgtgccttgtggaggagggtacggacggccgcctctcccggcggtacggcgccgcgccggtgtgcaagttcctcacccccaacgaggacggcgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacccgcgattcaaccgcgtgttcaacgaagcgatgaagaacaactccatcatcatcaccaagaagctcctcgagctctacgacggcttccagggcatcggcaccctcgtcgacgtcggcggcagcgtcggcgccaccgtggccgccatcaccgcccactaccccgccatcgaggggatcaacttcgacctcccccatgtcatctccgaggcgccgccgttcccgggcgtcacccacgtcggcggcgacatgttcaagaaggtgccctcgggcgacgccatcctgatgaagtggatcctccacgactggagcgaccagcattgcgccacgctgctcaagaactgctacgacgcgctgccagcgcacggcaaggtggtactggtggagtgcatcctgccggtgcacccggaggccaagcccagctcgcagggggtgttccacgtcgacatgatcatgctcgcgcacaaccccggtggcagggagaggtacgagagggagttcgaggcgctcgccaagggagctggcttcgccggcttcaagtccacatacatctacgccaacgcctgggccatcgagttcaccaagtagatgagaatcgtgggtcttcgatcttgctggatgctgctgctgctcctgcggtcgatctgcatgtgtaccctttgcttggtttttcctctgttttccacaattttctcatgctctgaatctagtctgaattctgatggctgtgtcgtgaatctgctcggaatgtaccattaataacgctgttctgaaaaggttgcatatgttgtatgtgatgtaatgagatgatttctatcctttgttgaataaataaattgaagtgtctcaaaaaaaaaa

SEQ ID NO: 156 - protein, 350 aa, Festuca arundinacea
MAPAQPTLPRPPTRRRACTPSSSARRRSSQRRTPSSLASWRPWPPAGSRPPPRWPPSSRARRTRKHRTWWTACSGCWRRTTCRALWRRVRTAASPGGTAPRRCASSSPPTRTASPWRRSRSTRTRSSWRAGTTRTRSLTAASRSTRRTACRRSSTTAQTRDSTACSTKRRTTPSSSPRSSSSSTTASRASAPSSTSAAASAPPWPPSPPTTPPSRGSTSTSPMSSPRRRRSRASPTSAATCSRRCPRATPSSGSSTTGATSIAPRCSRTATTRCQRTARWYWWSASCRCTRRPSPARRGCSTSTSCSRTTPVAGRGTRGSSRRSPRELASPASSPHTSTPTPGPSSSPSR

SEQ ID NO: 157 - DNA, 1542 bp, Lolium perenne
aaccctcactaaagggaacaaaagctggagctccaccgcggtggcggccgctctagaactagtggatcccccgggctgcaggaattcggcacgagcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggcctcggcaccctcgtcgatgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacaccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattttgaattttaatggttgtgtcgccgatttgctcggaatgtaccattaataacgatgttttgaaaaggttgcgtatgttgtatacttgtatgtgatgtaatgagatgatttctctcctttgttgaatatacgagtaaattgaagtgaaaaaaaaaaaaaaaaaaaaaaa

SEQ ID NO: 158 - protein, 360 aa, Lolium perenne
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGTLVDVGGGVGATVAAIAAHYPTIKGVNFDLPHVISEAPQFPGVTHVGGDMFKEVPSGDTILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 159 - DNA, 1541 bp, Lolium perenne
aaccctcactaaagggaacaaaagctggagctccaccgcggtggcggccgctctagaactagtggatcccccgggctgcaggaattcggcacgagcccaccagcaccagcatctctcgatcggcagacgcatagatcgatggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggcctcggcaccctcgtcgatgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacaccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattttgaattttaatggttgtgtcgccgatttgctcggaatgtaccattaataacgatgttttgaaaaggttgcgtatgttgtatacttgtatgtgatgtaatgagatgatttctctcctttgttgaatatacgagtaaattgaagtgaaaaaaaaaaaaaaaaaaaaaaa

SEQ ID NO: 160 - protein, 351 aa, Lolium perenne
MAPPPPTWPRPPTRTRACSPSSSLPRRSSRRRTPSSLASWRSWWPPAASRPRPRWPPSSRPRRTRKRRTWWTAYSGCSRRTTSRAWWRRARTAASPGATAPRPCASSSPPTRTASPWRRSRSTRTRSSWRAGTTSRTRSLTAASRSTRPTACRRSSTTARTRASTASSTKGRTTPSSSPRSSSSSTTASRASAPSSMSAAASAPPWPPPPTTPPSRGSTSTSPTSSPRRRSSRASPTSVATCSRRCPRETPSSSGSSTTGATSTAPRCSRTATTRCRRTARSCSSSASCRSTRRPIPARRGSSTSTSCSRTTPAAGRGTRGSSRLSPGEPDSPASSPRTSTPTRGPSSSPS

SEQ ID NO: 161 - DNA, 1496 bp, Lolium perenne
gagctccaccgcggtggcggccgctctagaactagtggatcccccgggctgcaggaattcggcacgaggcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcggtacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgccaccctgctcaagaactgctacgacgcgctgcccgcccatgccaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtagtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagagtttgcataaaaaaaaaaaaaaaaaaaaaaa

SEQ ID NO: 162 - protein, 351 aa, Lolium perenne
MADEEACMFALQLANSAVLPMAIRTSIELGLLETLVGAGGKLLTPEEAVKKLPSKAKHPDAASMIDRMLRVLASYKVVTCEVEEGKDGSLSRRYGATPVCRWLAPNEDGASMAPFALLTQDRVFMEAWCHMKDAILEGGSAFHRAFGTSWFEYAGQDARFNRLFNEAMEHHSVILTKKLLELYKGFDGIGTLVDVAGGVGAVIHAITSKYPSIKGINFDLPHVIADAPPYPGVEHVSGDMFKKMPSGDAILMKWILNCFSDDECATLLKNCYDALPAHAKVINVECILPVNPDATNGAQALIAVDLSLLVYSPGGKERYHRDLEKLAKGAGFTSVTATYIFADFWAMEYTK

SEQ ID NO: 163 - DNA, 1495 bp, Lolium perenne
gagctccaccgcggtggcggccgctctagaactagtggatcccccgggctgcaggaattcggcacgaggcaagcagcaactggtagcatcaatcagacccatcctagcaagcagcaacaggtagcatcagcgacatgccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcggtacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgccaccctgctcaagaactgctacgacgcgctgcccgcccatgccaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtagtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagagtttgcataaaaaaaaaaaaaaaaaaaaaaa

SEQ ID NO: 164 - protein, 341 aa, Lolium perenne
MPTKRRACSLCSWPTRLCCRWRLGHPSSWAFWRLLWAPAGSCLPKRLSRSCRPRPSTRTRRPIACCVCSPRTRWRVRWRRARTAASRAATAPRRCAGGSPPTRTAPPWPRSLSSPRTASSWRRGATRTRSWRAAARSTGRSVRRGSSTQARTRASTDSSTRPWSTTRSSSPRSSSSCTRASTASAPWLMWQAAWAPSSTPSPPSTRASRGSTSTFPTSSPTPRLTPAWSTSAVTCSRRCPPATPSSSGSSTASATTSAPPCSRTATTRCPPMPKSSTSSASCRIRTPPTVRRRSPSIACLCTARAARRGTTGTWRSSPRAPALPASRPPTSSPTSGPWSTL

SEQ ID NO: 165 - DNA, 1505 bp, Lolium perenne
aaagggaacaaaagctggagctccaccgcggtggcggccgctctagaactagtggatcccccgggctgcaggctcgggtctctcgctcatactaccaaaaacacccagcagcacaccagcgtctctcggcccaggagaagcagacacaggcagagatgggctccaccgcagccgaaattgccgcgtccgccgacgaggaggcgtgcttgtacgccctccagctcggctcgtcgtcgatcctcccaatgacgctgaagaacaccatcgagcttggcctcctggagaccctcatggccgccggcgggaagtcgctgacccccaccgaggtggccgcaaagctcccgtgcgcagcgaagaacccggaagcaccagacatggtggaccgcatgctccggctgctggcgtcgtacaacgtagtgtcgtgccttgtggaggagggtacggatggccgcctctcccggcggtacggcgccgcgccggtgtgcaagttcctcacccccaacgaggacggtgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacccgcgcttcaaccgcgtgttcaacgaagcgatgaagaacaattcgatcatcatcaccaagaagctcctccagctctacgacggcttccagggcctcggcaccctcgtcgacgtcggcggcggcgtcggcgccaccgtggccgccatcaccgcacactaccccaccatcaaggggatcaacttcgacctcccccacgtcatctccgaggcgccgccgttcccgggcgtcacccacgtcggcggcgacatgttcaagaaggtgcccttgggcgacgccatcctgatgaagtggatcctccacgactggagtgaccagcattgtggcacgctgctcaagaactgctacgacgcgctgccaatgcacggtaaggtggtgctggtggagtgcatcctgccggtgaacccggaggccaagcccagctcgcagggggtgttccacgtcgacatgatcatgctcgcgcacaacccaggcggcagggagaggtacgagagggagtacgaggcgctcgccaggggagctggcttcgccggcttcaagtccacatacatctacgccaacgcctgggccatcgagttcaccaagtagacgagaatcatgggtcttcgatcttgctggatgctgctgctgctccttcggtcaatctgcatgtgtaccctttgcttggtatttcctctgttttccataattttctcatgctctgaatctattccgaattctgatggctgtcgtcgatctgctcggaatgtaataacgctgttcggaaaaggttgcatacagtatgttgtatgtgatgtaatgagatgatttatcccctttgttgaataaataaaaaaaaaaaaaaaaaaaaaa

SEQ ID NO: 166 - protein, 361 aa, Lolium perenne
MGSTAAEIAASADEEACLYALQLGSSSILPMTLKNTIELGLLETLMAAGGKSLTPTEVAAKLPCAAKNPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLQLYDGFQGLGTLVDVGGGVGATVAAITAHYPTIKGINFDLPHVISEAPPFPGVTHVGGDMFKKVPLGDAILMKWILHDWSDQHCGTLLKNCYDALPMHGKVVLVECILPVNPEAKPSSQGVFHVDMIMLAHNPGGRERYEREYEALARGAGFAGFKSTYIYANAWAIEFTK

SEQ ID NO: 167 - DNA, 1504 bp, Lolium perenne
aaagggaacaaaagctggagctccaccgcggtggcggccgctctagaactagtggatcccccgggctgcaggctcgggtctctcgctcatactaccaaaaacacccagcagcacaccagcgtctctcggcccaggagaagcagacacaggcagagatggctccaccgcagccgaaattgccgcgtccgccgacgaggaggcgtgcttgtacgccctccagctcggctcgtcgtcgatcctcccaatgacgctgaagaacaccatcgagcttggcctcctggagaccctcatggccgccggcgggaagtcgctgacccccaccgaggtggccgcaaagctcccgtgcgcagcgaagaacccggaagcaccagacatggtggaccgcatgctccggctgctggcgtcgtacaacgtagtgtcgtgccttgtggaggagggtacggatggccgcctctcccggcggtacggcgccgcgccggtgtgcaagttcctcacccccaacgaggacggtgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacccgcgcttcaaccgcgtgttcaacgaagcgatgaagaacaattcgatcatcatcaccaagaagctcctccagctctacgacggcttccagggcctcggcaccctcgtcgacgtcggcggcggcgtcggcgccaccgtggccgccatcaccgcacactaccccaccatcaaggggatcaacttcgacctcccccacgtcatctccgaggcgccgccgttcccgggcgtcacccacgtcggcggcgacatgttcaagaaggtgcccttgggcgacgccatcctgatgaagtggatcctccacgactggagtgaccagcattgtggcacgctgctcaagaactgctacgacgcgctgccaatgcacggtaaggtggtgctggtggagtgcatcctgccggtgaacccggaggccaagcccagctcgcagggggtgttccacgtcgacatgatcatgctcgcgcacaacccaggcggcagggagaggtacgagagggagtacgaggcgctcgccaggggagctggcttcgccggcttcaagtccacatacatctacgccaacgcctgggccatcgagttcaccaagtagacgagaatcatgggtcttcgatcttgctggatgctgctgctgctccttcggtcaatctgcatgtgtaccctttgcttggtatttcctctgttttccataattttctcatgctctgaatctattccgaattctgatggctgtcgtcgatctgctcggaatgtaataacgctgttcggaaaaggttgcatacagtatgttgtatgtgatgtaatgagatgatttatcccctttgttgaataaataaaaaaaaaaaaaaaaaaaaaa

SEQ ID NO: 168 - protein, 350 aa, Lolium perenne
MAPPQPKLPRPPTRRRACTPSSSARRRSSQRRTPSSLASWRPSWPPAGSRPPPRWPQSSRAQRRTRKHQTWWTACSGCWRRTTCRALWRRVRMAASPGGTAPRRCASSSPPTRTVSPWRRSRSTRTRSSWRAGTTRTRSLTAASRSTRRTACRRSSTTAQTRASTACSTKRRTIRSSSPRSSSSSTTASRASAPSSTSAAASAPPWPPSPHTTPPSRGSTSTSPTSSPRRRRSRASPTSAATCSRRCPWATPSSGSSTTGVTSIVARCSRTATTRCQCTVRWCWWSASCRTRRPSPARRGCSTSTSCSRTTQAAGRGTRGSTRRSPGELASPASSPHTSTPTPGPSSSPS

SEQ ID NO: 169 - DNA, 1366 bp, Lolium perenne
gaagagcgcataggtcactaaccagtacataatccccactgggaaagcccttcaccagccagacaagcagctcgatcggctgcacagctccgaagagggcaaactcatgggctccactggcgccgaaatggtcgtcatcccggcagcaaacaacgacgaagactcatgcacgtacgcgatgcagctggcggcagcgtgtatcttgccgatgacgctcaaaaacgccatcgagctaggcatgctggagatcctggtgggcgccggcgggaaggctctgtcgccgtccgaggtggccgcgcggctgccatcgaccactaccaacccggacgcgccggcaatggtggaccgcatgctgcggctgctggcgtcgttcaacgtggtgtcgtgcgaggtggaggagggtaaggacggccttctcgcccgccggtacggccccgcgccggtatgtaagtggctcacacccaacgaggacggcgtctccatggccgcgctgctcctcatgtgccacgataaggtcactatgaagagctggtatcatttgaaggacgcagtcctcaacggcggcctcccgttcgagaaggcgcacgggatgccggcgttcaagtaccacggcacggacccgcggttcaatcgcgtgtttaacgagggcatgaagaaccactccaccatcatcaccaagaagctcctcgagtcctacacgggcttcgacggcctccgcgccctcgtcgacatcggcggcggtaccggtgccaccatccacgccattacctcgaagtatccacaactcagcggagtcaacttcgacctcccccacgtcatctccgaggcaccgccatatcctggcgtacggcacatcggcggtgacatgttcaaggaggttccgtccggcgctgatgctatcctcatgaagtggatcctccatgactggactgacgagcaatgtgcgacgctgctgaggaactgctataatgcactccccccgcacggcaaggtggtcgtagtggagtgtgtcctaccggtgaacccggccgatgcctcgcgcaatgcgcagacggttttcacgatcgacatgatcatgctcacggacacccctggtggaaaggagaggtaccatagggaattcgaaatgctggcgaagggcgccggattcgccaatgtcaaggccacctacatttacgccaacgcttgggccatcgagttcaccaagtagatttggcctcggccgcccattttatatgttttccttgcttttccctagacctgaatttgcacttgattcgtgtaattttttacttatttttcaccttttccaaataaatgtggattgtaatggttgtttaaaaaaaaaaaaaaaaaaaaaaaaaaa

SEQ ID NO: 170 - protein, 367 aa, Lolium perenne
MGSTGAEMVVIPAANNDEDSCTYAMQLAAACILPMTLKNAIELGMLEILVGAGGKALSPSEVAARLPSTTTNPDAPAMVDRMLRLLASFNVVSCEVEEGKDGLLARRYGPAPVCKWLTPNEDGVSMAALLLMCHDKVTMKSWYHLKDAVLNGGLPFEKAHGMPAFKYHGTDPRFNRVFNEGMKNHSTIITKKLLESYTGFDGLRALVDIGGGTGATIHAITSKYPQLSGVNFDLPHVISEAPPYPGVRHIGGDMFKEVPSGADAILMKWILHDWTDEQCATLLRNCYNALPPHGKVVVVECVLPVNPADASRNAQTVFTIDMIMLTDTPGGKERYHREFEMLAKGAGFANVKATYIYANAWAIEFTK

SEQ ID NO: 171 - DNA, 1365 bp, Lolium perenne
gaagagcgcataggtcactaaccagtacataatccccactgggaaagcccttcaccagccagacaagcagctcgatcggctgcacagctccgaagagggcaaactcatggctccactggcgccgaaatggtcgtcatcccggcagcaaacaacgacgaagactcatgcacgtacgcgatgcagctggcggcagcgtgtatcttgccgatgacgctcaaaaacgccatcgagctaggcatgctggagatcctggtgggcgccggcgggaaggctctgtcgccgtccgaggtggccgcgcggctgccatcgaccactaccaacccggacgcgccggcaatggtggaccgcatgctgcggctgctggcgtcgttcaacgtggtgtcgtgcgaggtggaggagggtaaggacggccttctcgcccgccggtacggccccgcgccggtatgtaagtggctcacacccaacgaggacggcgtctccatggccgcgctgctcctcatgtgccacgataaggtcactatgaagagctggtatcatttgaaggacgcagtcctcaacggcggcctcccgttcgagaaggcgcacgggatgccggcgttcaagtaccacggcacggacccgcggttcaatcgcgtgtttaacgagggcatgaagaaccactccaccatcatcaccaagaagctcctcgagtcctacacgggcttcgacggcctccgcgccctcgtcgacatcggcggcggtaccggtgccaccatccacgccattacctcgaagtatccacaactcagcggagtcaacttcgacctcccccacgtcatctccgaggcaccgccatatcctggcgtacggcacatcggcggtgacatgttcaaggaggttccgtccggcgctgatgctatcctcatgaagtggatcctccatgactggactgacgagcaatgtgcgacgctgctgaggaactgctataatgcactccccccgcacggcaaggtggtcgtagtggagtgtgtcctaccggtgaacccggccgatgcctcgcgcaatgcgcagacggttttcacgatcgacatgatcatgctcacggacacccctggtggaaaggagaggtaccatagggaattcgaaatgctggcgaagggcgccggattcgccaatgtcaaggccacctacatttacgccaacgcttgggccatcgagttcaccaagtagatttggcctcggccgcccattttatatgttttccttgcttttccctagacctgaatttgcacttgattcgtgtaattttttacttatttttcaccttttccaaataaatgtggattgtaatggttgtttaaaaaaaaaaaaaaaaaaaaaaaaaaa

SEQ ID NO: 172 - protein, 357 aa, Lolium perenne
MAPLAPKWSSSRQQTTTKTHARTRCSWRQRVSCRRSKTPSSACWRSWWAPAGRLCRRPRWPRGCHRPLPTRTRRQWWTACCGCWRRSTWCRARWRRVRTAFSPAGTAPRRYVSGSHPTRTASPWPRCSSCATIRSLRAGIIRTQSSTAASRSRRRTGCRRSSTTARTRGSIACLTRARTTPPSSPRSSSSPTRASTASAPSSTSAAVPVPPSTPLPRSIHNSAESTSTSPTSSPRHRHILAYGTSAVTCSRRFRPALMLSSSGSSMTGLTSNVRRCGTAIMHSPRTARWSWSVSYRTRPMPRAMRRRFSRSTSCSRTPLVERRGTIGNSKCWRRAPDSPMSRPPTFTPTLGPSSSPS

SEQ ID NO: 173 - DNA, 2051 bp, Festuca arundinacea
gagagcatcaacctaaaacccacgcgatcgaacacccctagaaaaaaaaacaaaaacaaaaagattacagttcctggtttgagtatcaatcgatggtgggcttcgctaagatcgccatggagtggctccaagaaccactgagctggctgttcatcgcctccgtggttttcgtggttctgcagcggcggcggcggggcaacgtggcgccgtttcccccgggcccgaagccgctgccgatcgtcggcaacatgtcgatgatggaccagctgacccaccgtggcctggcggcgctcgcgaaggagtacggcggccttctccacatccggctcgggaagctccatgcctttgccgtgtcgacgccggaatatgcccgggaggtgctgcaggtgcaggacggcgccttctcgaaccgtcccgcgaccatcgccatcgcttacctcacctacgaccgagccgacatggcgttcgcgcactacgggcccttctggcgccagatgcgcaagctgtgcgtgatgaagctcttcagccggcgccggccggagacgtggctcgccgtgcgcgacgagtccgcggcgctcgtccgcgccgtggccaggcggagcggcgagtccgtggacctcggcgagctcatttttaaactcaccaagaatgtcatcttccgcgccgcgttcggcgctggtgcggtcgccggcgacggcgacggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcgccgccctcgacgagttcatcgacaagatcatcgacgagcacatggagaggggcaagaatcccgacgacgccgacgccgacatggtggacgacatgctcgcgttcctcccggagacgaagccgaagaagggcgccgccggcgacggcgtggacgacctgcagaacacgctccgcctcacccgtgacaacatcaaggccatcatcatggacgtgatgtttggcgggacggagacggtggcgtcggcgatcgagtgggcgatggcggagatgatgcacagccccggcgacctccgccgcctgcagcaggagctcgccgacgtcgtggggctcgaccggaacgtggacgagtcggacctcgacaagctccccttcctcaagtgcgtcatcaaggagacgctccggctgcacccgcccatcccgctgctcctccacgagaccgccgaggactgcatcgtcggcggctactccgtgccccggggttcccgcgtcatgatcaacgtctacgccatcggccgcgaccgcaaggcgtggaaggacgccgacgtgttccggccgtcgcggttcgtgcagggggaaggggaggccgccgggctcgacttcaaggggggatgcttcgagttcttgccctttgggtccggccgccgctcctgccctggcatggcgctcggcctgtacgcactggagctcgccgtggcgcagctcgcgcacgggttcagctgggagctgcccgacgggatgaagccgtcggagctggacatgagcgacgtcttcggcctcaccgcgccgcgcgccaccaggctcttcgccgtgcccacgccccgcctcgcatgcacccagctgctgggggctgacgacgccgggcgtcaggcgtgacgtcgtcgtgcgcgcgcgcggccattgttgtgttagcaagcgatcgatggtatatgtaccagctggaagatgaaggtgtttgatatattcagaggtgatggcggcggcgccattggtggagcttggtggttttctcttgctttttttacaactgttgttttactttgaactcaattaagtctggtcacaacagaacacaataagcggattatcatgctcgctggatgcatgcttaggatacagttaagcatggcgtgttctaccatcaagaccgcaaattgtataaaaagtttttagacctgctgcaccgcaaattgtataaaaaaaaaa

SEQ ID NO: 174 - protein, 542 aa, Festuca arundinacea
MVGFAKIAMEWLQEPLSWLFIASVVFVVLQRRRRGNVAPFPPGPKPLPIVGNMSMMDQLTHRGLAALAKEYGGLLHIRLGKLHAFAVSTPEYAREVLQVQDGAFSNRPATIAIAYLTYDRADMAFAHYGPFWRQMRKLCVMKLFSRRRPETWLAVRDESAALVRAVARRSGESVDLGELIFKLTKNVIFRAAFGAGAVAGDGDGDGAGKQDEFIAILQEFSKLFGAFNIGDFIPWLSWADPQGINVRLRAARAALDEFIDKIIDEHMERGKNPDDADADMVDDMLAFLPETKPKKGAAGDGVDDLQNTLRLTRDNIKAIIMDVMFGGTETVASAIEWAMAEMMHSPGDLRRLQQELADVVGLDRNVDESDLDKLPFLKCVIKETLRLHPPIPLLLHETAEDCIVGGYSVPRGSRVMINVYAIGRDRKAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 175 - DNA, 2039 bp, Festuca arundinacea
gagagcatcaacctaaaacccacgcgatcgaacacccctagaaaaaaaaacaaaaacaaaaagattacagttcctggtttgagtatcaatcgatgtgggcttcgctaagatcgccatggagtggctccaagaaccactgagctggctgttcatcgcctccgtggttttcgtggttctgcagcggcggcggcggggcaacgtggcgccgtttcccccgggcccgaagccgctgccgatcgtcggcaacatgtcgatgatggaccagctgacccaccgtggcctggcggcgctcgcgaaggagtacggcggccttctccacatccggctcgggaagctccatgcctttgccgtgtcgacgccggaatatgcccgggaggtgctgcaggtgcaggacggcgccttctcgaaccgtcccgcgaccatcgccatcgcttacctcacctacgaccgagccgacatggcgttcgcgcactacgggcccttctggcgccagatgcgcaagctgtgcgtgatgaagctcttcagccggcgccggccggagacgtggctcgccgtgcgcgacgagtccgcggcgctcgtccgcgccgtggccaggcggagcggcgagtccgtggacctcggcgagctcatttttaaactcaccaagaatgtcatcttccgcgccgcgttcggcgctggtgcggtcgccggcgacggcgacggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcgccgccctcgacgagttcatcgacaagatcatcgacgagcacatggagaggggcaagaatcccgacgacgccgacgccgacatggtggacgacatgctcgcgttcctcccggagacgaagccgaagaagggcgccgccggcgacggcgtggacgacctgcagaacacgctccgcctcacccgtgacaacatcaaggccatcatcatggacgtgatgtttggcgggacggagacggtggcgtcggcgatcgagtgggcgatggcggagatgatgcacagccccggcgacctccgccgcctgcagcaggagctcgccgacgtcgtggggctcgaccggaacgtggacgagtcggacctcgacaagctccccttcctcaagtgcgtcatcaaggagacgctccggctgcacccgcccatcccgctgctcctccacgagaccgccgaggactgcatcgtcggcggctactccgtgccccggggttcccgcgtcatgatcaacgtctacgccatcggccgcgaccgcaaggcgtggaaggacgccgacgtgttccggccgtcgcggttcgtgcagggggaaggggaggccgccgggctcgacttcaaggggggatgcttcgagttcttgccctttgggtccggccgccgctcctgccctggcatggcgctcggcctgtacgcactggagctcgccgtggcgcagctcgcgcacgggttcagctgggagctgcccgacgggatgaagccgtcggagctggacatgagcgacgtcttcggcctcaccgcgccgcgcgccaccaggctcttcgccgtgcccacgccccgcctcgcatgcacccagctgctgggggctgacgacgccgggcgtcaggcgtgacgtcgtcgtgcgcgcgcgcggccattgttgtgttagcaagcgatcgatggtatatgtaccagctggaagatgaaggtgtttgatatattcagaggtgatggcggcggcgccattggtggagcttggtggttttctcttgctttttttacaactgttgttttactttgaactcaattaagtctggtcacaacagaacacaataagcggattatcatgctcgctggatgcatgcttaggatacagttaagcatggcgtgttctaccatcaagaccgcaaattgtataaaaagtttttagacctgctgcaccgcaaattgta

SEQ ID NO: 176 - protein, 460 aa, Festuca arundinacea
MWASLRSPWSGSKNHAGCSSPPWFSWFCSGGGGATWRRFPRARSRCRSSATCRWTSPTVAWRRSRRSTAAFSTSGSGSSMPLPCRRRNMPGRCCRCRTAPSRTVPRPSPSLTSPTTEPTWRSRTTGPSGARCASCASSSAGAGRRRGSPCATSPRRSSAPWPGGAASPWTSASSFLNSPRMSSSAPRSALVRSPATATATEQGSRTSSSPSSRSSPSSSAPSTSETSSRGAGRTRRASTCASAPRAPPSTSSSTRSSTSTWRGARIPTTPTPTWWTTCSRSSRRRSRRRAPPATAWTTCRTRSASPVTTSRPSSWTCLAGRRRWRRRSSGRWRRCTAPATSAACSRSSPTSWGSTGTWTSRTSTSSPSSSASSRRRSGCTRPSRCSSTRPPRTASSAATPCPGVPASSTSTPSAATARRGRTPTCSGRRGSCRGKGRPPGSTSRGDASSSCPLGPAAAPA

SEQ ID NO: 177 - DNA, 2101 bp, Lolium perenne
catcaacctaaaacccacgcgatccaacaccccctagagaaaaacaaaaacaaaaagattacagtttctggtttgagtatcaatcgatggtgggcttcgctaagatcgccatggagtggatccaagatccactgagctggctgttcatcgcctccgtggttttcgtggttctgcagcggcggcggcggggcaacgtggcgccgtttcccccgggcccgaaaccgctgccgatcgtcggcaacatgtcgatgatggaccagctcacccaccgtggcctggcggcgctagcgaaggagtacggcggccttctccacatccggctcggtaagctccacacctttgccgtgtcgacgccagagtatgcccgggaggtgctgcaggtgcaggacggtgccttctcgaaccgtcccgcgaccatcgccatcgcgtacctcacctacgaccgagccgacatggcgttcgcgcactacgggcccttctggcgccagatgcgcaagctgtgcgtgatgaagctcttcagccggcgccgcccggagacgtggctcgccgtgcgcgacgagtccgcggctctcgtccgcgccgtggccaggcggaccggcgagtccgtggacctcggcgagctcatttttaaactcaccaagaatgtcatcttccgcgccgcgttcggagctggtgcggtcgccgccgacgccgaggagggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcaacgccctcgacgagttcatcgacaagatcatcgacgagcacatggagaggggcaagaatcccgatgatgccgatgccgacatggtggacgacatgctcgcgttcctcccggaggcgaagccgaagaagggcgccgccggcgacggcgtggacgacctgcagaacacgctccgcctcacccgcgacaacatcaaggccattatcatggacgtgatgtttggcgggacggagacggtggcgtcggcgatcgagtgggcgatggcggagatgatgcacagccccgacgacctccgccgcctgcagcaggagctcgtcgacgtggtggggctcgaccggaacgtggacgagtcggacctcgacaagctccccttcctcaagtgcgtcatcaaggagacgctccggctgcacccgcccatcccgctgctcctccacgagaccgccgaggactgcgtcgtcggcggctactccgtgccccggggctcccgcgtcatgatcaacgtctacgccatcggccgcgaccgcagggcgtggaaggacgccgacgtgttccggccgtcgcggttcgtgcagggggaaggggaggccgccgggctcgacttcaaggggggatgcttcgagttcctgcccttcgggtcaggccgccgctcctgccctggcatggcgctcggcctgtacgcgctggagctcgccgtggcgcagctcgcgcacggtttcagctgggagctgcccgacgggatgaagccgtcggagctggacatgagcgacgtcttcggcctcaccgccccgcgcgccaccaggctcttcgccgtgcccacgccccgcctcgcatgcacccagctgctgggagctgacgacgccgggcgccaggcgtgacggccattgctgtgttagcaagcgatcgatggtatatgtaccagctggccggaagatgaaggtgtttgatatattcagaggtgatggcggaggcgccattggtggagcttggtggttttatcttgctttttttttactatttttcttatactttgaactcaattaagtctggtgacaacagaacacaataagcggattatcatgcttgctggatgcatgcttggatacagtgttaagcatgatgtgttctaccatgaagaacgcaaattgtaaaaacaagtttttagacctgctgcaccgagattctgtattttcttcctcttggttttccatcgtgagtactatattaatgccaggatgatagttccagttgaaaaaaaaaa

SEQ ID NO: 178 - protein, 543 aa, Lolium perenne
MVGFAKIAMEWIQDPLSWLFIASVVFVVLQRRRRGNVAPFPPGPKPLPIVGNMSMMDQLTHRGLAALAKEYGGLLHIRLGKLHTFAVSTPEYAREVLQVQDGAFSNRPATIAIAYLTYDRADMAFAHYGPFWRQMRKLCVMKLFSRRRPETWLAVRDESAALVRAVARRTGESVDLGELIFKLTKNVIFRAAFGAGAVAADAEEGDGAGKQDEFIAILQEFSKLFGAFNIGDFIPWLSWADPQGINVRLRAARNALDEFIDKIIDEHMERGKNPDDADADMVDDMLAFLPEAKPKKGAAGDGVDDLQNTLRLTRDNIKAIIMDVMFGGTETVASAIEWAMAEMMHSPDDLRRLQQELVDVVGLDRNVDESDLDKLPFLKCVIKETLRLHPPIPLLLHETAEDCVVGGYSVPRGSRVMINVYAIGRDRRAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 179 - DNA, 2085 bp, Lolium perenne
catcaacctaaaacccacgcgatccaacaccccctagagaaaaacaaaaacaaaaagattacagtttctggtttgagtatcaatcgatgtgggcttcgctaagatcgccatggagtggatccaagatccactgagctggctgttcatcgcctccgtggttttcgtggttctgcagcggcggcggcggggcaacgtggcgccgtttcccccgggcccgaaaccgctgccgatcgtcggcaacatgtcgatgatggaccagctcacccaccgtggcctggcggcgctagcgaaggagtacggcggccttctccacatccggctcggtaagctccacacctttgccgtgtcgacgccagagtatgcccgggaggtgctgcaggtgcaggacggtgccttctcgaaccgtcccgcgaccatcgccatcgcgtacctcacctacgaccgagccgacatggcgttcgcgcactacgggcccttctggcgccagatgcgcaagctgtgcgtgatgaagctcttcagccggcgccgcccggagacgtggctcgccgtgcgcgacgagtccgcggctctcgtccgcgccgtggccaggcggaccggcgagtccgtggacctcggcgagctcatttttaaactcaccaagaatgtcatcttccgcgccgcgttcggagctggtgcggtcgccgccgacgccgaggagggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcaacgccctcgacgagttcatcgacaagatcatcgacgagcacatggagaggggcaagaatcccgatgatgccgatgccgacatggtggacgacatgctcgcgttcctcccggaggcgaagccgaagaagggcgccgccggcgacggcgtggacgacctgcagaacacgctccgcctcacccgcgacaacatcaaggccattatcatggacgtgatgtttggcgggacggagacggtggcgtcggcgatcgagtgggcgatggcggagatgatgcacagccccgacgacctccgccgcctgcagcaggagctcgtcgacgtggtggggctcgaccggaacgtggacgagtcggacctcgacaagctccccttcctcaagtgcgtcatcaaggagacgctccggctgcacccgcccatcccgctgctcctccacgagaccgccgaggactgcgtcgtcggcggctactccgtgccccggggctcccgcgtcatgatcaacgtctacgccatcggccgcgaccgcagggcgtggaaggacgccgacgtgttccggccgtcgcggttcgtgcagggggaaggggaggccgccgggctcgacttcaaggggggatgcttcgagttcctgcccttcgggtcaggccgccgctcctgccctggcatggcgctcggcctgtacgcgctggagctcgccgtggcgcagctcgcgcacggtttcagctgggagctgcccgacgggatgaagccgtcggagctggacatgagcgacgtcttcggcctcaccgccccgcgcgccaccaggctcttcgccgtgcccacgccccgcctcgcatgcacccagctgctgggagctgacgacgccgggcgccaggcgtgacggccattgctgtgttagcaagcgatcgatggtatatgtaccagctggccggaagatgaaggtgtttgatatattcagaggtgatggcggaggcgccattggtggagcttggtggttttatcttgctttttttttactatttttcttatactttgaactcaattaagtctggtgacaacagaacacaataagcggattatcatgcttgctggatgcatgcttggatacagtgttaagcatgatgtgttctaccatgaagaacgcaaattgtaaaaacaagtttttagacctgctgcaccgagattctgtattttcttcctcttggttttccatcgtgagtactatattaatgccaggatgatagttcc

SEQ ID NO: 180 - protein, 362 aa, Lolium perenne
MWASLRSPWSGSKIHAGCSSPPWFSWFCSGGGGATWRRFPRARNRCRSSATCRWTSSPTVAWRRRRSTAAFSTSGSVSSTPLPCRRQSMPGRCCRCRTVPSRTVPRPSPSRTSPTTEPTWRSRTTGPSGARCASCASSSAGAARRRGSPCATSPRLSSAPWPGGPASPWTSASSFLNSPRMSSSAPRSELVRSPPTPRRATEQGSRTSSSPSSRSSPSSSAPSTSETSSRGAGRTRRASTCASAPRATPSTSSSTRSSTSTWRGARIPMMPMPTWWTTCSRSSRRRSRRRAPPATAWTTCRTRSASPATTSRPLSWTCLAGRRRWRRRSSGRWRRCTAPTTSAACSRSSSTWWGSTGTWTSR

SEQ ID NO: 181 - DNA, 2460 bp, Lolium perenne
gttctttgcaacgatcaacactgtcagaatccagatacacacacacacacacacacaccaagcagcgtctagctagcttacttgctctagtagttctttgcaaatatccatggagtccgagaacgttgccgccaacggcgatggcctgtgcgtggcacagccggctcgcgccgaccctctgaactggggaaaagcagccgaggagctgtctgggagccatcttgatgccgtgaagcgaatggtggaggagtaccgccgccctgtggtgaccatggaaggcgccagcctgactatcgccatggtcgctgcggtggctgccggcgccgacaccagggtggagctcgacgagtccgcccgcggacgcgtcaaggagagcagcgactgggtcatgaacagcatggccaacggcaccgacagctacggtgtcaccaccggcttcggtgccacctcccaccggaggaccaaggagggtggcgctctccagagagagctcatcaggtttctcaatgcgggagcattcggcaccggcagcgatggccacgtcctgcccgctgcgacgacgagggctgccatgcttgtccgtgtcaacaccctgctccagggctactctggtatccgctttgagatcctcgagacggtcgccacgcttctcaacgccaacgtgacaccgtgcctaccgctccggggcacgatcacggcatccggtgacctcgttccgctgtcctacatcgcgggccttgtgaccggccgcccaaattctgtggcgactgctccggatggcacgaaggttaacgctgcagaggcattcaaaatcgcgggcatccagcacggtttctttgagctgcagcctaaggaaggccttgccatggtcaacggcaccgcggtgggctccggactggcgtccatggtgctcttcgaggctaacatccttggcatcctcgctgaggttctgtcggctgtgttctgtgaggtcatgaacggcaagccagagtacaccgaccacctcacgcacaagttgaagcaccaccctggtcagattgaggccgcggctatcatggagcacatccttgaaggaagctcctacatgatgctcgcgaagaagctcggcgagctcgacccactgatgaagccgaagcaagataggtatgcccttcgaacatcaccgcaatggctgggccctcagattgaggttatccgtgccgccaccaagtccatcgagcgcgagatcaactccgtcaacgacaacccgctcatcgacgtctctcgaggcaaggccatccatggtggcaacttccagggcacacccatcggtgtgtccatggataacaccaggcttgccattgctgcgatcggcaagctcatgtttgcccagttctctgagctagtgaacgacttctacaacaatggtttgccttccaatctctcgggtgggcgcaacccgagcttggactatggcttcaagggtgctgagattgccatggcctcctattgctccgagctccaattcttgggcaaccctgtgactaaccatgtgcagagtgcggagcagcacaaccaagacgtcaactctcttggtctcatctctgctaggaagacctctgaggccatcgatattctgaagctcatgtcatcgacattcttggttgcactgtgccaagctatcgacctccgccacctcgaggagaatgtcaagaatgccgtcaagaactgtgtgaagatggtggctaggaagaccctgagcaccaatgacagtggccatctccacagcgcacgcttctgcgagaaggacctgctcttgacgatcgaccgcgaggcggtgttcgcctacgcagacgacccttgcagcgctaactacccactgatgcagaagatgcgtgcagttctcgtggagcacgccttggccaacggtgaggctgagcgggatgtgcagacgtcagtgttcgccaagcttgccgcattcgagcaggagctccgtgcagtgcttccaagggaggtcgagtcagcccggtgtgctgtggagaatggcaccgccgcgcagcaaaaccgcatcaccgaatgccggtcgtacccgctgtaccgcttcgtgcgcaaggagctcggaaccgagtacttgaccggagagaagacgaggtctcctggtgaagaggtggacaaggtgtttgtggctatgaaccaggggaaacacatcgacgcactgcttgagtgcctcaaggagtggaacggtgagcccctgcctatctgctgaagaatgaatcaaggaactgaagaatagagtacttgagagttcagaaggctccacatgtgcttagttaatagtaagtatagtactgttttttcattgtatcttgtgcattatatatacatgtaacactggaataaaatttcaaaaaatcagatcactcaatgggcagcatgtaacactggaataaaaatttcaaaaaaatcagatcaaaaaaaaaa

SEQ ID NO: 182 - protein, 711 aa, Lolium perenne
MESENVAANGDGLCVAQPARADPLNWGKAAEELSGSHLDAVKRMVEEYRRPVVTMEGASLTIAMVAAVAAGADTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETVATLLNANVTPCLPLRGTITASGDLVPLSYIAGLVTGRPNSVATAPDGTKVNAAEAFKIAGIQHGFFELQPKEGLAMVNGTAVGSGLASMVLFEANILGILAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTSEAIDILKLMSSTFLVALCQAIDLRHLEENVKNAVKNCVKMVARKTLSTNDSGHLHSARFCEKDLLLTIDREAVFAYADDPCSANYPLMQKMRAVLVEHALANGEAERDVQTSVFAKLAAFEQELRAVLPREVESARCAVENGTAAQQNRITECRSYPLYRFVRKELGTEYLTGEKTRSPGEEVDKVFVAMNQGKHIDALLECLKEWNGEPLPIC

SEQ ID NO: 183 - DNA, 2447 bp, Lolium perenne
gttctttgcaacgatcaacactgtcagaatccagatacacacacacacacacacacaccaagcagcgtctagctagcttacttgctctagtagttctttgcaaatatccatgagtccgagaacgttgccgccaacggcgatggcctgtgcgtggcacagccggctcgcgccgaccctctgaactggggaaaagcagccgaggagctgtctgggagccatcttgatgccgtgaagcgaatggtggaggagtaccgccgccctgtggtgaccatggaaggcgccagcctgactatcgccatggtcgctgcggtggctgccggcgccgacaccagggtggagctcgacgagtccgcccgcggacgcgtcaaggagagcagcgactgggtcatgaacagcatggccaacggcaccgacagctacggtgtcaccaccggcttcggtgccacctcccaccggaggaccaaggagggtggcgctctccagagagagctcatcaggtttctcaatgcgggagcattcggcaccggcagcgatggccacgtcctgcccgctgcgacgacgagggctgccatgcttgtccgtgtcaacaccctgctccagggctactctggtatccgctttgagatcctcgagacggtcgccacgcttctcaacgccaacgtgacaccgtgcctaccgctccggggcacgatcacggcatccggtgacctcgttccgctgtcctacatcgcgggccttgtgaccggccgcccaaattctgtggcgactgctccggatggcacgaaggttaacgctgcagaggcattcaaaatcgcgggcatccagcacggtttctttgagctgcagcctaaggaaggccttgccatggtcaacggcaccgcggtgggctccggactggcgtccatggtgctcttcgaggctaacatccttggcatcctcgctgaggttctgtcggctgtgttctgtgaggtcatgaacggcaagccagagtacaccgaccacctcacgcacaagttgaagcaccaccctggtcagattgaggccgcggctatcatggagcacatccttgaaggaagctcctacatgatgctcgcgaagaagctcggcgagctcgacccactgatgaagccgaagcaagataggtatgcccttcgaacatcaccgcaatggctgggccctcagattgaggttatccgtgccgccaccaagtccatcgagcgcgagatcaactccgtcaacgacaacccgctcatcgacgtctctcgaggcaaggccatccatggtggcaacttccagggcacacccatcggtgtgtccatggataacaccaggcttgccattgctgcgatcggcaagctcatgtttgcccagttctctgagctagtgaacgacttctacaacaatggtttgccttccaatctctcgggtgggcgcaacccgagcttggactatggcttcaagggtgctgagattgccatggcctcctattgctccgagctccaattcttgggcaaccctgtgactaaccatgtgcagagtgcggagcagcacaaccaagacgtcaactctcttggtctcatctctgctaggaagacctctgaggccatcgatattctgaagctcatgtcatcgacattcttggttgcactgtgccaagctatcgacctccgccacctcgaggagaatgtcaagaatgccgtcaagaactgtgtgaagatggtggctaggaagaccctgagcaccaatgacagtggccatctccacagcgcacgcttctgcgagaaggacctgctcttgacgatcgaccgcgaggcggtgttcgcctacgcagacgacccttgcagcgctaactacccactgatgcagaagatgcgtgcagttctcgtggagcacgccttggccaacggtgaggctgagcgggatgtgcagacgtcagtgttcgccaagcttgccgcattcgagcaggagctccgtgcagtgcttccaagggaggtcgagtcagcccggtgtgctgtggagaatggcaccgccgcgcagcaaaaccgcatcaccgaatgccggtcgtacccgctgtaccgcttcgtgcgcaaggagctcggaaccgagtacttgaccggagagaagacgaggtctcctggtgaagaggtggacaaggtgtttgtggctatgaaccaggggaaacacatcgacgcactgcttgagtgcctcaaggagtggaacggtgagcccctgcctatctgctgaagaatgaatcaaggaactgaagaatagagtacttgagagttcagaaggctccacatgtgcttagttaatagtaagtatagtactgttttttcattgtatcttgtgcattatatatacatgtaacactggaataaaatttcaaaaaatcagatcactcaatgggcagcatgtaacactggaataaaaatttcaaaaaaatcaga

SEQ ID NO: 184 - protein, 635 aa, Lolium perenne
MSPRTLPPTAMACAWHSRLAPTLTGEKQPRSCLGAILMPSEWWRSTAALWPWKAPALSPWSLRWLPAPTPGWSSTSPPADASRRAATGSTAWPTAPTATVSPPASVPPPTGGPRRVALSRESSSGFSMREHSAPAAMATSCPLRRRGLPCLSVSTPCSRATLVSALRSSRRSPRFSTPTHRAYRSGARSRHPVTSFRCPTSRALPAAQILWRLLRMARRLTLQRHSKSRASSTVSLSCSLRKALPWSTAPRWAPDWRPWCSSRLTSLASSLRFCRLCSVRSTASQSTPTTSRTSSTTLVRLRPRLSWSTSLKEAPTCSRRSSASSTHSRSKIGMPFEHHRNGWALRLRLSVPPPSPSSARSTPSTTTRSSTSLEARPSMVATSRAHPSVCPWITPGLPLLRSASSCLPSSLSTTSTTMVCLPISRVGATRAWTMASRVLRLPWPPIAPSSNSWATLLTMCRVRSSTTKTSTLLVSSLLGRPLRPSIFSSCHRHSWLHCAKLSTSATSRRMSRMPSRTVRWWLGRPAPMTVAISTAHASARRTCSRSTARRCSPTQTTLAALTTHCRRCVQFSWSTPWPTVRLSGMCRRQCSPSLPHSSRSSVQCFQGRSSQPGVLWRMAPPRSKTASPNAGRTRC

SEQ ID NO: 185 - DNA, 2595 bp, Festuca arundinacea
ctcctctgtaattcgagctcctcttcagcacaagtacttccaccagagtgccagacaacaatccagcaccacttccagaatacatacacacacgtacccgtgtctaaaccttacttgctttcctagttctttgcatatctccatggagtgcgagaacgggcacgttgccgccaacggcgatggcctctgcgtggcgcagccagcccgggccgaccctctcaactgggggaaggcagcagaggagctgtccgggagccatttggatgccgtgaagcggatggtcgaagagtaccgcagaccagtcgtgaccatggagggcgccagcttgaccattgctatggtcgccgcggtggccgccggcgccgacacccgggtggagctcgacgagtccgcccgcggacgcgtcaaggagagcagcgactgggtcatgaacagcatggcgaacggtaccgacagctatggtgtcaccaccggcttcggcgccacctcacaccggaggaccaaggagggtggcgctctgcagagagagctcatcaggttccttaacgcgggagcatttggcaccggcagcgatggccatgttttgcccgctgcaacaaccagggcggccatgctcgtccgtgtcaacactctgctccaggggtactctggcatccgcttcgaaattctcgagacgatcgccacgcttctcaatgccaacgtgacgccgtgcctaccgctccggggcacaatcacggcatccggcgacctcgtcccattatcctacatcgccggccttgtgactggccgcccaaactctgtggcgacagctccagatggcagcaaggttaacgcagcagaggctttcaagattgccggcatccagcatggcttctttgagctgcagcccaaggaaggccttgccatggtcaacggcactgccgtgggctccgggctcgcgtccatagtgcttttcgaagctaacatccttggcatccttgccgaggttctatcggccgtgttctgcgaggtgatgaatggcaagccggagtacaccgaccacctaacacacaagctgaagcaccacccgggccagatcgaggccgcggccatcatggagcacatccttgaaggcagctcctacatgatgctcgcgaagaagctcggtgagctcgacccactgatgaagccaaaacaagataggtatgcactccgcacatcaccacaatggctcggccctcagatcgaggtcatccgtgctgctaccaagtccatcgagcgtgagatcaactccgtcaacgacaacccactcatcgacgtctcccgcggcaaggctatccacggtggcaacttccagggcacgcccatcggtgtgtccatggacaacaccaggcttgccattgcggccatcggcaagctcatgtttgcccagttctcggagcttgtgaacgatttctacaacaacggtttgccttccaatctctctggtgggcgcaatccgagcttggactatggcttcaagggtgctgagattgctatggcctcatactgctccgagctccagttcttgggcaaccctgtgactaaccatgtgcagagcgccgagcagcacaatcaagacgtcaactctctcggcctcatctcttccaggaagaccgctgaggcgattgacattttgaagctcatgtcctcgacattcatggttgccttgtgccaagctatcgacctccgccacatcgaggagaatgtcaagaatgccgtcaagaactgtgtgaagacggtggctaggaagaccctgagcaccaatgacagtgggcatctccacaatgcacgcttctgcgagaaggacctgctcctgacgatcgaccgtgaggcggtgttcgcctacgcagatgacccttgcagcgccaactacccgctgatgcagaagatgcgtgcggttctcgtggagcatgccttggccaacggtgaagccgagcaggacgtgcagacgtcagtgttcgccaagcttgccacattcgagcaagagctccgtgcggttcttcccaaggaggtcgagtctgcccggtgttccgtggagaacggcaccgccgcacagcagaaccgcatcagcgaatgccggtcatacccgctctatcgcttcgtgcgcaaggagctcgggactgagtatttgaccggagagaagacgaggtctcctggtgaagaggtggacaaggtgtttgttgctatgaaccagggtaagcacattgacgcgctgcttgagtgcctcaaggagtggaacggtgagcccctgcctatctgctgaagaatggctcaaggaactcaagaatagagtgcttgagaattcagatggtactgttttataattatatctccggatatcgatgtttgcaatgttcctccagagctgcaatgccagttagaaaagataatagcatgacttggtagtgttgtttagcctagaaattttctatgatgttagttagtaaaagggtacactttgtgataaatatacataattattgcactagtcctttatttttatatcaatgttctgtctactgaggcaactttgaaggattcaaagaatctagtattggcctgccaaaaaaaaaa

SEQ ID NO: 186 - protein, 713 aa, Festuca arundinacea
MECENGHVAANGDGLCVAQPARADPLNWGKAAEELSGSHLDAVKRMVEEYRRPVVTMEGASLTIAMVAAVAAGADTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNSVATAPDGSKVNAAEAFKIAGIQHGFFELQPKEGLAMVNGTAVGSGLASIVLFEANILGILAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFMVALCQAIDLRHIEENVKNAVKNCVKTVARKTLSTNDSGHLHNARFCEKDLLLTIDREAVFAYADDPCSANYPLMQKMRAVLVEHALANGEAEQDVQTSVFAKLATFEQELRAVLPKEVESARCSVENGTAAQQNRISECRSYPLYRFVRKELGTEYLTGEKTRSPGEEVDKVFVAMNQGKHIDALLECLKEWNGEPLPIC

SEQ ID NO: 187 - DNA, 2586 bp, Festuca arundinacea
ctcctctgtaattcgagctcctcttcagcacaagtacttccaccagagtgccagacaacaatccagcaccacttccagaatacatacacacacgtacccgtgtctaaaccttacttgctttcctagttctttgcatatctccatgagtgcgagaacgggcacgttgccgccaacggcgatggcctctgcgtggcgcagccagcccgggccgaccctctcaactgggggaaggcagcagaggagctgtccgggagccatttggatgccgtgaagcggatggtcgaagagtaccgcagaccagtcgtgaccatggagggcgccagcttgaccattgctatggtcgccgcggtggccgccggcgccgacacccgggtggagctcgacgagtccgcccgcggacgcgtcaaggagagcagcgactgggtcatgaacagcatggcgaacggtaccgacagctatggtgtcaccaccggcttcggcgccacctcacaccggaggaccaaggagggtggcgctctgcagagagagctcatcaggttccttaacgcgggagcatttggcaccggcagcgatggccatgttttgcccgctgcaacaaccagggcggccatgctcgtccgtgtcaacactctgctccaggggtactctggcatccgcttcgaaattctcgagacgatcgccacgcttctcaatgccaacgtgacgccgtgcctaccgctccggggcacaatcacggcatccggcgacctcgtcccattatcctacatcgccggccttgtgactggccgcccaaactctgtggcgacagctccagatggcagcaaggttaacgcagcagaggctttcaagattgccggcatccagcatggcttctttgagctgcagcccaaggaaggccttgccatggtcaacggcactgccgtgggctccgggctcgcgtccatagtgcttttcgaagctaacatccttggcatccttgccgaggttctatcggccgtgttctgcgaggtgatgaatggcaagccggagtacaccgaccacctaacacacaagctgaagcaccacccgggccagatcgaggccgcggccatcatggagcacatccttgaaggcagctcctacatgatgctcgcgaagaagctcggtgagctcgacccactgatgaagccaaaacaagataggtatgcactccgcacatcaccacaatggctcggccctcagatcgaggtcatccgtgctgctaccaagtccatcgagcgtgagatcaactccgtcaacgacaacccactcatcgacgtctcccgcggcaaggctatccacggtggcaacttccagggcacgcccatcggtgtgtccatggacaacaccaggcttgccattgcggccatcggcaagctcatgtttgcccagttctcggagcttgtgaacgatttctacaacaacggtttgccttccaatctctctggtgggcgcaatccgagcttggactatggcttcaagggtgctgagattgctatggcctcatactgctccgagctccagttcttgggcaaccctgtgactaaccatgtgcagagcgccgagcagcacaatcaagacgtcaactctctcggcctcatctcttccaggaagaccgctgaggcgattgacattttgaagctcatgtcctcgacattcatggttgccttgtgccaagctatcgacctccgccacatcgaggagaatgtcaagaatgccgtcaagaactgtgtgaagacggtggctaggaagaccctgagcaccaatgacagtgggcatctccacaatgcacgcttctgcgagaaggacctgctcctgacgatcgaccgtgaggcggtgttcgcctacgcagatgacccttgcagcgccaactacccgctgatgcagaagatgcgtgcggttctcgtggagcatgccttggccaacggtgaagccgagcaggacgtgcagacgtcagtgttcgccaagcttgccacattcgagcaagagctccgtgcggttcttcccaaggaggtcgagtctgcccggtgttccgtggagaacggcaccgccgcacagcagaaccgcatcagcgaatgccggtcatacccgctctatcgcttcgtgcgcaaggagctcgggactgagtatttgaccggagagaagacgaggtctcctggtgaagaggtggacaaggtgtttgttgctatgaaccagggtaagcacattgacgcgctgcttgagtgcctcaaggagtggaacggtgagcccctgcctatctgctgaagaatggctcaaggaactcaagaatagagtgcttgagaattcagatggtactgttttataattatatctccggatatcgatgtttgcaatgttcctccagagctgcaatgccagttagaaaagataatagcatgacttggtagtgttgtttagcctagaaattttctatgatgttagttagtaaaagggtacactttgtgataaatatacataattattgcactagtcctttatttttatatcaatgttctgtctactgaggcaactttgaaggattcaaagaatctagtattggcctgccaa

SEQ ID NO: 188 - protein, 404 aa, Festuca arundinacea
MSARTGTLPPTAMASAWRSQPGPTLSTGGRQQRSCPGAIWMPSGWSKSTADQSPWRAPAPLLWSPRWPPAPTPGWSSTSPPADASRRAATGSTAWRTVPTAMVSPPASAPPHTGGPRRVALCRESSSGSLTREHLAPAAMAMFCPLQQPGRPCSSVSTLCSRGTLASASKFSRRSPRFSMPTRRAYRSGAQSRHPATSSHYPTSPALLAAQTLWRQLQMAARLTQQRLSRLPASSMASLSCSPRKALPWSTALPWAPGSRPCFSKLTSLASLPRFYRPCSARMASRSTPTTHTSSTTRARSRPRPSWSTSLKAAPTCSRRSSVSSTHSQNKIGMHSAHHHNGSALRSRSSVLLPSPSSVRSTPSTTTHSSTSPAARLSTVATSRARPSVCPWTTPGLPLRPSAS

SEQ ID NO: 189 - DNA, 1205 bp, Festuca arundinacea
gcaagcttccctcgattagctaccttgtctagccaccgtcgtccttgcacagccaaggaagaagcaaagctatttggcttctaacaatggcgacgaggggtgtcatggtggcgctgctgctcgcggcggtggcggcgtcttgcgctcatgcacagctgcacgagaagttctacagtgagtcgtgccccagcgtggaggacgtcgtccggaaggagatggtcatggcgctatccctcgcgccaagcctcgccgcgccgctcctcaggatgcacttccacgactgcttcgtcagggggtgcgacggctcggttctgctggactcggcgaacaagacggcggagaaggacgcgctgcccaaccagacgctgcgcggcttcgacttcgtcgagagggtgaaggccgccgtggagaaggcctgccccgacaccgtctcctgcgccgacgtggtcacgctcatagccagggacgctgtctggctgagcaaaggcccattctgggaagttcctttgggccggcgagacggcagcgtgtccatctccaacgagaccgacgcgctgccccctcccaccgccaacatcaccgtgctcacccagctcttcgccgccaagaaccttgacatcaaggacctcgtcgtcctctctgccgcgcacacgatcgggacatcgcactgcttctccttctccgaccggctctacaacttcacgggcctcgacaacgccagcgacatcgaccccacccttgaacctttctacatggcaaagctgaagagcaagtgcaccagtctcgacgacaacagcacgctcgtggaaatggaccccgggagcttcaagaccttcgacctcgactacttcaagctcgtcagcaagcggaggggcctcttccactccgacggtgccctcctcaccgacgccttcacccgtgcctacatcctgcgccacgccaccggcgccttcaaggacgagttcttcgccgactttgccgtctccatggtaaagatgggcaacaccgacgtgctcactggaagccagggcgagatcaggaagaagtgctccgtggtgaaccattagttagccgtggaagtaccggttggcataccaacccttttgatttgtgaccatgttttttttctgtgtagattattactgtaaaaccgttacttcattttcctctccccaagttcttttcttcgttggttaaaaaaaaaa

SEQ ID NO: 190 - protein, 326 aa, Festuca arundinacea
MATRGVMVALLLAAVAASCAHAQLHEKFYSESCPSVEDVVRKEMVMALSLAPSLAAPLLRMHFHDCFVRGCDGSVLLDSANKTAEKDALPNQTLRGFDFVERVKAAVEKACPDTVSCADVVTLIARDAVWLSKGPFWEVPLGRRDGSVSISNETDALPPPTANITVLTQLFAAKNLDIKDLVVLSAAHTIGTSHCFSFSDRLYNFTGLDNASDIDPTLEPFYMAKLKSKCTSLDDNSTLVEMDPGSFKTFDLDYFKLVSKRRGLFHSDGALLTDAFTRAYILRHATGAFKDEFFADFAVSMVKMGNTDVLTGSQGEIRKKCSVVNH

SEQ ID NO: 191 - DNA, 1204 bp, Festuca arundinacea
gcaagcttccctcgattagctaccttgtctagccaccgtcgtccttgcacagccaaggaagaagcaaagctatttggcttctaacaatgcgacgaggggtgtcatggtggcgctgctgctcgcggcggtggcggcgtcttgcgctcatgcacagctgcacgagaagttctacagtgagtcgtgccccagcgtggaggacgtcgtccggaaggagatggtcatggcgctatccctcgcgccaagcctcgccgcgccgctcctcaggatgcacttccacgactgcttcgtcagggggtgcgacggctcggttctgctggactcggcgaacaagacggcggagaaggacgcgctgcccaaccagacgctgcgcggcttcgacttcgtcgagagggtgaaggccgccgtggagaaggcctgccccgacaccgtctcctgcgccgacgtggtcacgctcatagccagggacgctgtctggctgagcaaaggcccattctgggaagttcctttgggccggcgagacggcagcgtgtccatctccaacgagaccgacgcgctgccccctcccaccgccaacatcaccgtgctcacccagctcttcgccgccaagaaccttgacatcaaggacctcgtcgtcctctctgccgcgcacacgatcgggacatcgcactgcttctccttctccgaccggctctacaacttcacgggcctcgacaacgccagcgacatcgaccccacccttgaacctttctacatggcaaagctgaagagcaagtgcaccagtctcgacgacaacagcacgctcgtggaaatggaccccgggagcttcaagaccttcgacctcgactacttcaagctcgtcagcaagcggaggggcctcttccactccgacggtgccctcctcaccgacgccttcacccgtgcctacatcctgcgccacgccaccggcgccttcaaggacgagttcttcgccgactttgccgtctccatggtaaagatgggcaacaccgacgtgctcactggaagccagggcgagatcaggaagaagtgctccgtggtgaaccattagttagccgtggaagtaccggttggcataccaacccttttgatttgtgaccatgttttttttctgtgtagattattactgtaaaaccgttacttcattttcctctccccaagttcttttcttcgttggttaaaaaaaaaa

SEQ ID NO: 192 - protein, 320 aa, Festuca arundinacea
MRRGVSWWRCCSRRWRRLALMHSCTRSSTVSRAPAWRTSSGRRWSWRYPSRQASPRRSSGCTSTTASSGGATARFCWTRRTRRRRRTRCPTRRCAASTSSRGRPPWRRPAPTPSPAPTWSRSPGTLSGAKAHSGKFLWAGETAACPSPTRPTRCPLPPPTSPCSPSSSPPRTLTSRTSSSSLPRTRSGHRTASPSPTGSTTSRASTTPATSTPPLNLSTWQSRASAPVSTTTARSWKWTPGASRPSTSTTSSSSASGGASSTPTVPSSPTPSPVPTSCATPPAPSRTSSSPTLPSPWRWATPTCSLEARARSGRSAPWTI

SEQ ID NO: 193 - DNA, 1266 bp, Festuca arundinacea
ggccagataacaagtgcaggcagcaaaccagttacaggcacgccgcaatatagcttgggtcttgtagctagccatagccatggcatctgcctcttgcatttctttggtgttgctggtggctctggccgccacggcggcgtcggcgcagctgtcgtcaacgttctatgacacgtcgtgccccagggccctggccaccatcaagagcggcgtggcggccgccgtgagcagcaacccccgcatgggtgcgtcgctgctcaggctgcacttccacgactgctttgttaatggctgtgacgcgtccgttctgctgtcgggcaacgagcagaacgcgcccgcgaacgccggttcgctgtttggcttcggcgtcatcgacaacatcaagacccagctcgagggtatctgcaagcagaccgtctcctgcgccgacatcctcaccgtcgccgcccgtgactctgtcgtcgccctcggaggcccgtcatggacagttcctctcggcagacgggactcgacgagcgcaaccggcaataccggggacctcccgggccctggatccagcctcgcacagctccaggccgcgttcgccaagaagaacctgaacaccgtggacatggtagcgctctccggcgcgcacaccatcgggcgggcgcagtgccagaacttccggtcgcggatctacggcggcgactctaacatcaacgccgccttcgcgacctcgctcaaggccaactgcccgcagtccggcggcaacggcaacctggcggcgctggacgccacgaccgccaacgccttcgacaacgcctactacaccaacctgctctcccagaaggggctcctccactccgaccaggtgctcttcaacaacggcagcaccgacaacaccgtcaggaacttcgcgtccagcggggcggcgttcagcagcgccttcgcgacggcgatgatcaagatgggcaacatctcgccgctgacagggacgcaggggcagatcaggctcagctgctccaaggtgaactcgtgattagcgtacgaggagccgacagacagtcgccagcactatacgtcacgtgaatgaataaggccacagaaccggcggccaatccacagtactattagcagttcagcactagctagaaccgtgtatatatatacgtgcagctcaaaattattcatgcacctctacacatgtaactatcgaattctctcatgcaaaggcataaagaattacttcaatatatacaactacaactaccattattctcaaaaaaaaaa

SEQ ID NO: 194 - protein, 358 aa, Festuca arundinacea
MASSRVLLLVVAALAISVSATAAATKISAPLPPLAKGLNFDFYKATCPQAESIVFNFLRDAIRKDVGLAAALLRIHFHDCFVQGCDGSVLLDKTGGTDSEKIAPPNVTLRPTAFKAINDLRALLAKACGAVVSCADIAALAARDSVHLAGGPHYPVPLGRRDGLAPANLTTILNALPAPSSNVTTLLRFLAKISLDANDLVALSGAHTLGIAHCTSFQERLFPQNDVTLNKWFASQLRLTCPALNTDNTTNNDIRTPNVFDNKYYVDLLNRQGLFTSDQDLHTDARTKPTVTRFAVDQAAFFDQFVFSVVKMGQINVLTGSQGQIRNDCSAPNKGRTNDDLPWSVLETVTEAAQSLVL

SEQ ID NO: 195 - DNA, 1265 bp, Festuca arundinacea
ggccagataacaagtgcaggcagcaaaccagttacaggcacgccgcaatatagcttgggtcttgtagctagccatagccatgcatctgcctcttgcatttctttggtgttgctggtggctctggccgccacggcggcgtcggcgcagctgtcgtcaacgttctatgacacgtcgtgccccagggccctggccaccatcaagagcggcgtggcggccgccgtgagcagcaacccccgcatgggtgcgtcgctgctcaggctgcacttccacgactgctttgttaatggctgtgacgcgtccgttctgctgtcgggcaacgagcagaacgcgcccgcgaacgccggttcgctgtttggcttcggcgtcatcgacaacatcaagacccagctcgagggtatctgcaagcagaccgtctcctgcgccgacatcctcaccgtcgccgcccgtgactctgtcgtcgccctcggaggcccgtcatggacagttcctctcggcagacgggactcgacgagcgcaaccggcaataccggggacctcccgggccctggatccagcctcgcacagctccaggccgcgttcgccaagaagaacctgaacaccgtggacatggtagcgctctccggcgcgcacaccatcgggcgggcgcagtgccagaacttccggtcgcggatctacggcggcgactctaacatcaacgccgccttcgcgacctcgctcaaggccaactgcccgcagtccggcggcaacggcaacctggcggcgctggacgccacgaccgccaacgccttcgacaacgcctactacaccaacctgctctcccagaaggggctcctccactccgaccaggtgctcttcaacaacggcagcaccgacaacaccgtcaggaacttcgcgtccagcggggcggcgttcagcagcgccttcgcgacggcgatgatcaagatgggcaacatctcgccgctgacagggacgcaggggcagatcaggctcagctgctccaaggtgaactcgtgattagcgtacgaggagccgacagacagtcgccagcactatacgtcacgtgaatgaataaggccacagaaccggcggccaatccacagtactattagcagttcagcactagctagaaccgtgtatatatatacgtgcagctcaaaattattcatgcacctctacacatgtaactatcgaattctctcatgcaaaggcataaagaattacttcaatatatacaactacaactaccattattctcaaaaaaaaaa

SEQ ID NO: 196 - protein, 305 aa, Festuca arundinacea
MHLPLAFLWCCWWLWPPRRRRRSCRQRSMTRRAPGPWPPSRAAWRPPAATPAWVRRCSGCTSTTALLMAVTRPFCCRATSRTRPRTPVRCLASASSTTSRPSSRVSASRPSPAPTSSPSPPVTLSSPSEARHGQFLSADGTRRAQPAIPGTSRALDPASHSSRPRSPRRTTPWTWRSPARTPSGGRSARTSGRGSTAATLTSTPPSRPRSRPTARSPAATATWRRWTPRPPTPSTTPTTPTCSPRRGSSTPTRCSSTTAAPTTPSGTSRPAGRRSAAPSRRRSRWATSRRQGRRGRSGSAAPRTR

SEQ ID NO: 197 - DNA, 1301 bp, Festuca arundinacea
ggtcccttgtatcagctgatcatggctttttccggcagcgtcagcggcgttgttctcgtcgtggcgatcctgcttctgggtctggccgcggcggcgtcggcacagctgtcggcgacgttctacgacgcgtcctgcccgagcgcgctcgcgacgatcaagagcgccgtgacggcggcggtgaacaacgaggcccgcatgggagcctccctgctcaggctccacttccacgactgtttcgtccaaggatgcgacgcgtcggtgctcctcaacgacaccgccaacttcaccggcgagcagacggccttccccaaccgcaactccatcaggggactcaacgtcatcgacaacgtcaaggcgcaggtcgaggccgtatgcacgcagaccgtctcctgcgccgacatcctcgccgtcgccgcccgcgactccatcgtcgccctaggagggccgtcgtacacggttccgctggggaggagggactccaccaccgcgagcctgtccgaggcgaacagggacctcccgccgccgtcctccgacctcgccgatctcgtcggcaacttctccaggaaaggcctcagcgtcaccgacatggttgcgctctcaggagcccacacgatcgggcgggcggcatgcttaaacttccggagccggatctacggcgagtccaacatcgccccggcgtacgcggcgtcgctgcaggccaactgcccgcagtccgcccccaatggcgacggtacactcgcaccgctcgacgtgtccacccccgacgccttcgacaacgcctactacggcaacctgctctcgcagcaggggctcctccactcggaccagcagctcttcaacggcggctcgaccgactccctcgtcagcacctacgcctccaacgccgcgcagttcagcggcgacttcgccgcggccatggtgaacatgggcaacatcggcgtgctcaccggcgcccagggggagatccggctcaattgtggcaaggtgaattgagtgaaagcccgacaactgagactgcaggtgaaagtggatggggcacatgcaattgcgaagctgggctggtagctttactgaaaccgaataaggtgtcaacgtgaaggccatattgatgtgcttattgggcctatcttggaattccttacagggattcagattcagtcatttctccttcgcatggtctatttgtttcccacagaaaataaggatataataatactgtataatcctgtaaaaaaaggaaacgatactgtatagttgtgcctatcaacaaccacatttctggttgaaagctaaaaaaaaaa

SEQ ID NO: 198 - protein, 323 aa, Festuca arundinacea
MAFSGSVSGVVLVVAILLLGLAAAASAQLSATFYDASCPSALATIKSAVTAAVNNEARMGASLLRLHFHDCFVQGCDASVLLNDTANFTGEQTAFPNRNSIRGLNVIDNVKAQVEAVCTQTVSCADILAVAARDSIVALGGPSYTVPLGRRDSTTASLSEANRDLPPPSSDLADLVGNFSRKGLSVTDMVALSGAHTIGRAACLNFRSRIYGESNIAPAYAASLQANCPQSAPNGDGTLAPLDVSTPDAFDNAYYGNLLSQQGLLHSDQQLFNGGSTDSLVSTYASNAAQFSGDFAAAMVNMGNIGVLTGAQGEIRLNCGKVN

SEQ ID NO: 199 - DNA, 1300 bp, Festuca arundinacea
ggtcccttgtatcagctgatcatgctttttccggcagcgtcagcggcgttgttctcgtcgtggcgatcctgcttctgggtctggccgcggcggcgtcggcacagctgtcggcgacgttctacgacgcgtcctgcccgagcgcgctcgcgacgatcaagagcgccgtgacggcggcggtgaacaacgaggcccgcatgggagcctccctgctcaggctccacttccacgactgtttcgtccaaggatgcgacgcgtcggtgctcctcaacgacaccgccaacttcaccggcgagcagacggccttccccaaccgcaactccatcaggggactcaacgtcatcgacaacgtcaaggcgcaggtcgaggccgtatgcacgcagaccgtctcctgcgccgacatcctcgccgtcgccgcccgcgactccatcgtcgccctaggagggccgtcgtacacggttccgctggggaggagggactccaccaccgcgagcctgtccgaggcgaacagggacctcccgccgccgtcctccgacctcgccgatctcgtcggcaacttctccaggaaaggcctcagcgtcaccgacatggttgcgctctcaggagcccacacgatcgggcgggcggcatgcttaaacttccggagccggatctacggcgagtccaacatcgccccggcgtacgcggcgtcgctgcaggccaactgcccgcagtccgcccccaatggcgacggtacactcgcaccgctcgacgtgtccacccccgacgccttcgacaacgcctactacggcaacctgctctcgcagcaggggctcctccactcggaccagcagctcttcaacggcggctcgaccgactccctcgtcagcacctacgcctccaacgccgcgcagttcagcggcgacttcgccgcggccatggtgaacatgggcaacatcggcgtgctcaccggcgcccagggggagatccggctcaattgtggcaaggtgaattgagtgaaagcccgacaactgagactgcaggtgaaagtggatggggcacatgcaattgcgaagctgggctggtagctttactgaaaccgaataaggtgtcaacgtgaaggccatattgatgtgcttattgggcctatcttggaattccttacagggattcagattcagtcatttctccttcgcatggtctatttgtttcccacagaaaataaggatataataatactgtataatcctgtaaaaaaaggaaacgatactgtatagttgtgcctatcaacaaccacatttctggttgaaagctaaaaaaaaaa

SEQ ID NO: 200 - protein, 317 aa, Festuca arundinacea
MLFPAASAALFSSWRSCFWVWPRRRRHSCRRRSTTRPARARSRRSRAPRRRTTRPAWEPPCSGSTSTTVSSKDATRRCSSTTPPTSPASRRPSPTATPSGDSTSSTTSRRRSRPYARRPSPAPTSSPSPPATPSSPEGRRTRFRWGGGTPPPRACPRRTGTSRRRPPTSPISSATSPGKASASPTWLRSQEPTRSGGRHATSGAGSTASPTSPRRTRRRCRPTARSPPPMATVHSHRSTCPPPTPSTTPTTATCSRSRGSSTRTSSSSTAARPTPSSAPTPPTPRSSAATSPRPWTWATSACSPAPRGRSGSIVARI

SEQ ID NO: 201 - DNA, 1059 bp, Lolium perenne
acgagggagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaa

SEQ ID NO: 202 - protein, 293 aa, Lolium perenne
TRENYYGSSCPTALLTIRTVVTTAVLLDHRMGASLLRLHFHDCFVQGCDASVLLDDTAGFTGEKGAGPNAGSLRGLEVIDKIKMLLEFMCPRTVSCADILAVAARDSVVRLGGPSWAVQLGRRDATTASASLASSDLPGPNSNLNDLLTAFSKKGLSTTDMVALSGAHTIGRAQCQNYRNRIYTDTDIDGAFAASLRGGCPQAGGDGNLAPLDASSPNTFDNGYFSGLLSRQGLLHSDQALYDGGSTDDLVRTYASNNDQFGSDFAAAMVKLSNIGLLTGSSGEIRVNCRAVN

SEQ ID NO: 203 - DNA, 1058 bp, Lolium perenne
acgagggagaactactacgggtcttcttgtcccaccgcgcttctcaccatcaggactgtcgtgacgacggcggtgctgctggaccaccgcatggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaa

SEQ ID NO: 204 - protein, 255 aa, Lolium perenne
MALLFSGSTSTTALCKGATRPFCWMTRPASPARRGPGRTPGRCAVWRSTRSRCCWSSCARGPSPAPTSSPSPPATPSSVGGHHGRFNLEGGTPPQQARHLLVVTSQAPTPTSMISSPLSPKKDAPRTWLLYQGPIPSAGRSARTTGTGSTPTPTLTGHSQRPCEAAAHRPAATATSRRSTRPLPTPSITATSPASSPARGCSIPTRRCTTAAPRTIWSGPTPPITISLAATSLRRWNAISACRGRPGRSGSTAGR

SEQ ID NO: 205 - DNA, 1204 bp, Lolium perenne
atccccaaacccaaaaggtgaggcctccagatacttggatctccaatggctcctgctactcccaaggacagctctgctctgcctggtttgctcttgctcttcgcagcagcgacgtccgtggcggtagcgaacgcacagctatcagagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaaaaaaaaa

SEQ ID NO: 206 - protein, 324 aa, Lolium perenne
MAPATPKDSSALPGLLLLFAAATSVAVANAQLSENYYGSSCPTALLTIRTVVTTAVLLDHRMGASLLRLHFHDCFVQGCDASVLLDDTAGFTGEKGAGPNAGSLRGLEVIDKIKMLLEFMCPRTVSCADILAVAARDSVVRLGGPSWAVQLGRRDATTASASLASSDLPGPNSNLNDLLTAFSKKGLSTTDMVALSGAHTIGRAQCQNYRNRIYTDTDIDGAFAASLRGGCPQAGGDGNLAPLDASSPNTFDNGYFSGLLSRQGLLHSDQALYDGGSTDDLVRTYASNNDQFGSDFAAAMVKLSNIGLLTGSSGEIRVNCRAVN

SEQ ID NO: 207 - DNA, 1203 bp, Lolium perenne
atccccaaacccaaaaggtgaggcctccagatacttggatctccaatgctcctgctactcccaaggacagctctgctctgcctggtttgctcttgctcttcgcagcagcgacgtccgtggcggtagcgaacgcacagctatcagagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaaaaaaaaa

SEQ ID NO: 208 - protein, 315 aa, Lolium perenne
MLLLLPRTALLCLVCSCSSQQRRPWRRTHSYQRTTTGLLVPPRFSPSGLSRRRCCWTTAWALLFSGSTSTTALCKGATRPFCWMTRPASPARRGPGRTPGRCAVWRSTRSRCCWSSCARGPSPAPTSSPSPPATPSSVGGHHGRFNLEGGTPPQQARHLLVVTSQAPTPTSMISSPLSPKKDAPRTWLLYQGPIPSAGRSARTTGTGSTPTPTLTGHSQRPCEAAAHRPAATATSRRSTRPLPTPSITATSPASSPARGCSIPTRRCTTAAPRTIWSGPTPPITISLAATSLRRWNAISACRGRPGRSGSTAGRI

SEQ ID NO: 209 - DNA, 1236 bp, Lolium perenne
gagatggcttcttcttcctcccccttttctcgggtctcccagctagccgtcaaggcgacggtcctggcggccgtctgcctcctcctccacggcggaggcgggagtagcgcatcggcggcggagctgtgcgtgagctactacgaccacacgtgtccggacgcgtacaagatcgtgcagggggtgctggtggaggctcacaagtcggacccgcgcatcttcgccagcctcatccgcctccatttccacgactgcttcgtgctgggctgcgacggctcgctgctgctggacaccttccccggcttccagtccgagaaggacgcgcgccccaacaacaactcggcgcgcggctaccccgtcgtcgacgccgccaaggccgctctcgagaaggcgtgccccggagtcgtctcctgcgccgacatcctcgccctcgccgccgagatctccgtccagctgtccggaggacccgggtggggcgtgttgctggggaggctggacggtaagacctccagcatagccggcgcccagaacctacccggcccgttcgacggcctcaagaatctcacccttaagttccaagccgtcaatctcgacgttactgacctcgtcgctctctcaggtgctcacactttcggtcgcgtgaaatgccggttcgtcacgaaccgtctgtacaacttcagcgggacgaaccagcctgacccgaccctaaatgcggcttaccgggcgttcctgtcaacgagatgcccaaggaacggcgatgcaaactctctaaatgaccttgatccgacgacgcccgacacctttgacaagaactacttcacgaacctcgagaaaaatcgcggctttcttgactctgaccaacaactcaaatcagacccaggtgcattaacgacgacggcgccgattgtcgataggtttgcaagcagccaggacgcattctttaagagcttcgcatggtctatgatcaagatgggaaacattctgccaattacagatccctcccgtggagaagtccggaaacactgcgcgtttgtcaattgatgttaattagcaagaaggccacatgtggatacaactacggcctatgctatatgcgcaaaatcatggatctcattgtcatgttcaataattggtaatatatatgccaaccaatgtacgtaagattatgtgcatgctttgatcccacaagtgcaatgaagtgaaatcttatttcccgtttgaggttgatcaaaaaaaaaa

SEQ ID NO: 210 - protein, 344 aa, Lolium perenne
MASSSSPFSRVSQLAVKATVLAAVCLLLHGGGGSSASAAELCVSYYDHTCPDAYKIVQGVLVEAHKSDPRIFASLIRLHFHDCFVLGCDGSLLLDTFPGFQSEKDARPNNNSARGYPVVDAAKAALEKACPGVVSCADILALAAEISVQLSGGPGWGVLLGRLDGKTSSIAGAQNLPGPFDGLKNLTLKFQAVNLDVTDLVALSGAHTFGRVKCRFVTNRLYNFSGTNQPDPTLNAAYRAFLSTRCPRNGDANSLNDLDPTTPDTFDKNYFTNLEKNRGFLDSDQQLKSDPGALTTTAPIVDRFASSQDAFFKSFAWSMIKMGNILPITDPSRGEVRKHCAFVN

SEQ ID NO: 211 - DNA, 1235 bp, Lolium perenne
gagatgcttcttcttcctcccccttttctcgggtctcccagctagccgtcaaggcgacggtcctggcggccgtctgcctcctcctccacggcggaggcgggagtagcgcatcggcggcggagctgtgcgtgagctactacgaccacacgtgtccggacgcgtacaagatcgtgcagggggtgctggtggaggctcacaagtcggacccgcgcatcttcgccagcctcatccgcctccatttccacgactgcttcgtgctgggctgcgacggctcgctgctgctggacaccttccccggcttccagtccgagaaggacgcgcgccccaacaacaactcggcgcgcggctaccccgtcgtcgacgccgccaaggccgctctcgagaaggcgtgccccggagtcgtctcctgcgccgacatcctcgccctcgccgccgagatctccgtccagctgtccggaggacccgggtggggcgtgttgctggggaggctggacggtaagacctccagcatagccggcgcccagaacctacccggcccgttcgacggcctcaagaatctcacccttaagttccaagccgtcaatctcgacgttactgacctcgtcgctctctcaggtgctcacactttcggtcgcgtgaaatgccggttcgtcacgaaccgtctgtacaacttcagcgggacgaaccagcctgacccgaccctaaatgcggcttaccgggcgttcctgtcaacgagatgcccaaggaacggcgatgcaaactctctaaatgaccttgatccgacgacgcccgacacctttgacaagaactacttcacgaacctcgagaaaaatcgcggctttcttgactctgaccaacaactcaaatcagacccaggtgcattaacgacgacggcgccgattgtcgataggtttgcaagcagccaggacgcattctttaagagcttcgcatggtctatgatcaagatgggaaacattctgccaattacagatccctcccgtggagaagtccggaaacactgcgcgtttgtcaattgatgttaattagcaagaaggccacatgtggatacaactacggcctatgctatatgcgcaaaatcatggatctcattgtcatgttcaataattggtaatatatatgccaaccaatgtacgtaagattatgtgcatgctttgatcccacaagtgcaatgaagtgaaatcttatttcccgtttgaggttgatcaaaaaaaaaa

SEQ ID NO: 212 - protein, 336 aa, Lolium perenne
MLLLPPPFLGSPSPSRRRSWRPSASSSTAEAGVAHRRRSCAATTTTRVRTRTRSCRGCWWRLTSRTRASSPASSASISTTASCWAATARCCWTPSPASSPRRTRAPTTTRRAATPSSTPPRPLSRRRAPESSPAPTSSPSPPRSPSSCPEDPGGACCWGGWTVRPPAPAPRTYPARSTASRISPLSSKPSISTLLTSSLSQVLTLSVANAGSSRTVCTTSAGRTSLTRPMRLTGRSCQRDAQGTAMQTLMTLIRRRPTPLTRTTSRTSRKIAAFLTLTNNSNQTQVHRRRRRLSIGLQAARTHSLRASHGLSRWETFCQLQIPPVEKSGNTARLSI

SEQ ID NO: 213 - DNA, 1382 bp, Lolium perenne
ggccacaactcgccacatttggcatagcgagcactgacagcgagctacatccatcaccatggcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 214 - protein, 358 aa, Lolium perenne; identical to SEQ ID NO: 194

SEQ ID NO: 215 - DNA, 1381 bp, Lolium perenne
ggccacaactcgccacatttggcatagcgagcactgacagcgagctacatccatcaccatgcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 216 - protein, 357 aa, Lolium perenne
MLLAVSCSSSWQLWRSPCPPRPRPPRSVLHYRRWPRATSISTRPPARRPSPSSSTSSATPSARTSASPPRSSASTSTTASCRAATAPCSSTRPAAPTARRSHHPTSRSAPPPSRPSTTSALSSPRPAAPSSPAPTSPPWPRATPCTSPAGRTTPSRSAAATGSPPRTSPPSSTPSRHRAPTSPPSSDSSPRSASTPTTSSRYPARTRSASRTAPPSRSASSRRTTSPSTSGSRRSSGSPARRSTPTTPPTTTSAPPTSSTTSTTSTCSTARDSSPPTRTCTPTPGPSPPSPGSPSTRPPFSTSSSSPSSRWARSTCSPAARDRYATTAPRPTKAAPTTTCRGPCSRPSPRPPRAWCC

SEQ ID NO: 217 - DNA, 1382 bp, Lolium perenne
ggccacaactcgccacatctggcatagcgagcactgacagtgagctacatccatcaccatggcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 218 - DNA, 1381 bp, Lolium perenne
ggccacaactcgccacatctggcatagcgagcactgacagtgagctacatccatcaccatgcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 219 - protein, 357 aa, Lolium perenne; identical to SEQ ID NO: 216

SEQ ID NO: 220 - DNA, 1261 bp, Lolium perenne
gatcgcctttctcctccatgaccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtaaagcttacacagcatgcataaaagcatctatatcattccatttgagttgtaaaaaaaaaa

SEQ ID NO: 221 - protein, 344 aa, Lolium perenne
MTTMGGSSILPAPTVATTALVLLIVLFASPATVAKGSGLSVGFYKKLCPKAEKVVRRTVTKAFEKEPGTPADIIRLFFHDCFVRGCDASVLLESTPGRMAERDSKANNPSLDGFEVISDAKETLEKLCPQTVSCADILALAARDGAYLASGLDYAVPTGRRDGLVSKEDEVLPSVPHPDFNHSQLVENFTAKGFTAEEMVTLSGAHTIGTSHCSSFTDRLYNFSQGGALTTDPALPAAYAALLKEKCPPETAAQNDTTMVQLDDVTPFVMDNQYYKNLLAGTVPLGSDVALMESPDTAALVELYAREPAEYWAKRFVAAMVKVSEMEVLTGAEGEIRLNCSKVN

SEQ ID NO: 222 - DNA, 1260 bp, Lolium perenne
gatcgcctttctcctccatgccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtaaagcttacacagcatgcataaaagcatctatatcattccatttgagttgtaaaaaaaaaa

SEQ ID NO: 223 - protein, 335 aa, Lolium perenne
MPPWAARRSCPRRPWRRRRWFCSCCSHRRQRWRKVLGCPSGSTRSCVRRRRRSSGELSPRPLRRSLAPRPTSSASSFTTALSEGATHRCCWNPRQGAWRRGTRRQTTPAWMGLRSLATPRRPLRSSARKPSPVLTFSPSPPAMAPTSLAGSTMRCPPAAVMASSPRKTRFSLVSLTPTSTILSSWKTSRQKALRRRRWRCRGRTPSAPRTARPSRTASTTSPRAARPRTLRCRRHTPRCRRSARRRQRRRTTPPWCSSTTRRSWTTSTTRTCLPAPCRSAPTRSWRAPTRRRSSSSTPASPPSTGPSASLRRWSRARWRCSPGPRGRSGSTAPRT

SEQ ID NO: 224 - DNA, 1260 bp, Lolium perenne
atcgcctttctcctccatgaccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtatagcttacacagcatgcataaaagcatctatatcattccatttgagttgtaaaaaaaaaa

SEQ ID NO: 225 - DNA, 1253 bp, Lolium perenne
atcgcctttctcctccatgccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtatagcttacacagcatgcataaaagcatctatatcattccatttgagttgtaaaa

SEQ ID NO: 226 - protein, 406 aa, Lolium perenne
MGGSSILPAPTVATTALVLLIVLFASPATVAKGSGLSVGFYKKLCPKAEKVVRRTVTKAFEKEPGTPADIIRLFFHDCFVRGCDASVLLESTPGRMAERDSKANNPSLDGFEVISDAKETLEKLCPQTVSCADILALAARDGAYLASGLDYAVPTGRRDGLVSKEDEVLPSVPHPDFNHSQLVENFTAKGFTAEEMVTLSGAHTIGTSHCSSFTDRLYNFSQGGALTTDPALPAAYAALLKEKCPPETAAQNDTTMVQLDDVTPFVMDNQYYKNLLAGTVPLGSDVALMESPDTAALVELYAREPAEYWAKRFVAAMVKVSEMEVLTGAEGEIRLNCSKVNYITGCCVCLCTICLGKMTIHVLLLCCFFFHLFSYGGEKYIHICLRHKLYSLHSMHKSIYIIPFEL

SEQ ID NO: 227 - DNA, 1539 bp, Cynodon dactylon
atggacgtctccctcatcctctctgtgtccatcgcgctggtggcgatcccgctctcgctggcgctgctgaaccggctccgcctcgggcgcctgccgccgggcccgcggccctggcccgtggtgggcaacctccgccagatcaagcccgtgcggtgccgctgcttccaggagtgggcggagcggtacggccccatcatctccgtctggttcgggtccgggctcacggtggtcgtgtccacctccgagctcgcgcgggaggtgctcaaggagaacgaccagcagctcgccgaccggccgcggaaccgctccacgcagcggttcagccgcaacggccaggacctgatctgggccgactacggcccgcactacatcaaggtgcgcaagctctgcaacctcgagctcttcacgcccaagcgactcgaggcgctgcgccccatccgcgaggacgagatcaccgccatggtcgagtccgtccaccgcgccgccaccgccgccggtaatgaaggaaaaccaatggttgtgaggaaccacctttctatggtggccttcaacaatattacaaggcttgcatttgggaagcggttcatgaatgcgaatggtgagattgatgaacaggggcgtgagttcaagaccattgtcaacaacgggattaagatcggtgcatctctctctgttgctgagtttatttggtatttgaggtggttgtgtccgcttaacgaggagctatacaaaacccacaatgagagaagggatcgcctaaccaagaaaatcattgatgagcatgccaaagctctcaaggagagtggtgctaagcagcactttgttgatgcattgttcaccctcagggatcaatacaatcttagcgacgacacagttattggacttctatgggacatgatcactgctggaatggacaccacagtgatttcagtagaatgggcaatggcggagctagtcaggaacctcagggtgcagaagaagttgcaggaggaactggaccgtgttgttggccacgaccgtgtcatgtctgagactgatttccagaacctcccctaccttcaagccgtagtcaaagagtccctacggctgcacccgccgacaccactcatgctccctcacaaggcaagcacaagtgtcaagatcggcggctacaacatccccaagggggccaacgtgatggtgaatgtctgggcagtggcacgtgatcccaaggtgtggaacaacccactggagttcaggccggagcgcttcctggaggagaacattgatatcaagggtagcgacttcagggttcttcctttcggagctggccggcgagtgtgccccggtgcgcaacttggcatcaacctcgtagcctccatgatcgggcacctgctgcaccacttcgagtggtcactgccggagggcaccaagccggaggacgtcaacatgatggaatccgccggactcgtcacgttcatgggaaagccgctgcaagctgtagccaagccgcgcctgaagaaggaggagctgtacaagagggtcccggttgagatgtga

SEQ ID NO: 228 - protein, 512 aa, Cynodon dactylon
MDVSLILSVSIALVAIPLSLALLNRLRLGRLPPGPRPWPVVGNLRQIKPVRCRCFQEWAERYGPIISVWFGSGLTVVVSTSELAREVLKENDQQLADRPRNRSTQRFSRNGQDLIWADYGPHYIKVRKLCNLELFTPKRLEALRPIREDEITAMVESVHRAATAAGNEGKPMVVRNHLSMVAFNNITRLAFGKRFMNANGEIDEQGREFKTIVNNGIKIGASLSVAEFIWYLRWLCPLNEELYKTHNERRDRLTKKIIDEHAKALKESGAKQHFVDALFTLRDQYNLSDDTVIGLLWDMITAGMDTTVISVEWAMAELVRNLRVQKKLQEELDRVVGHDRVMSETDFQNLPYLQAVVKESLRLHPPTPLMLPHKASTSVKIGGYNIPKGANVMVNVWAVARDPKVWNNPLEFRPERFLEENIDIKGSDFRVLPFGAGRRVCPGAQLGINLVASMIGHLLHHFEWSLPEGTKPEDVNMMESAGLVTFMGKPLQAVAKPRLKKEELYKRVPVEM

SEQ ID NO: 229 - DNA, 1538 bp, Cynodon dactylon
atgacgtctccctcatcctctctgtgtccatcgcgctggtggcgatcccgctctcgctggcgctgctgaaccggctccgcctcgggcgcctgccgccgggcccgcggccctggcccgtggtgggcaacctccgccagatcaagcccgtgcggtgccgctgcttccaggagtgggcggagcggtacggccccatcatctccgtctggttcgggtccgggctcacggtggtcgtgtccacctccgagctcgcgcgggaggtgctcaaggagaacgaccagcagctcgccgaccggccgcggaaccgctccacgcagcggttcagccgcaacggccaggacctgatctgggccgactacggcccgcactacatcaaggtgcgcaagctctgcaacctcgagctcttcacgcccaagcgactcgaggcgctgcgccccatccgcgaggacgagatcaccgccatggtcgagtccgtccaccgcgccgccaccgccgccggtaatgaaggaaaaccaatggttgtgaggaaccacctttctatggtggccttcaacaatattacaaggcttgcatttgggaagcggttcatgaatgcgaatggtgagattgatgaacaggggcgtgagttcaagaccattgtcaacaacgggattaagatcggtgcatctctctctgttgctgagtttatttggtatttgaggtggttgtgtccgcttaacgaggagctatacaaaacccacaatgagagaagggatcgcctaaccaagaaaatcattgatgagcatgccaaagctctcaaggagagtggtgctaagcagcactttgttgatgcattgttcaccctcagggatcaatacaatcttagcgacgacacagttattggacttctatgggacatgatcactgctggaatggacaccacagtgatttcagtagaatgggcaatggcggagctagtcaggaacctcagggtgcagaagaagttgcaggaggaactggaccgtgttgttggccacgaccgtgtcatgtctgagactgatttccagaacctcccctaccttcaagccgtagtcaaagagtccctacggctgcacccgccgacaccactcatgctccctcacaaggcaagcacaagtgtcaagatcggcggctacaacatccccaagggggccaacgtgatggtgaatgtctgggcagtggcacgtgatcccaaggtgtggaacaacccactggagttcaggccggagcgcttcctggaggagaacattgatatcaagggtagcgacttcagggttcttcctttcggagctggccggcgagtgtgccccggtgcgcaacttggcatcaacctcgtagcctccatgatcgggcacctgctgcaccacttcgagtggtcactgccggagggcaccaagccggaggacgtcaacatgatggaatccgccggactcgtcacgttcatgggaaagccgctgcaagctgtagccaagccgcgcctgaagaaggaggagctgtacaagagggtcccggttgagatgtga

SEQ ID NO: 230 - protein, 494 aa, Cynodon dactylon
MTSPSSSLCPSRWWRSRSRWRCTGSASGACRRARGPGPWWATSARSSPCGAAASRSGRSGTAPSSPSGSGPGSRWSCPPPSSRGRCSRRTTSSSPTGRGTAPRSGSAATARTSGPTTARTTSRCASSATSSSSRPSDSRRCAPSARTRSPPWSSPSTAPPPPPVMKENQWLGTTFLWWPSTILQGLHLGSGSMRMVRLMNRGVSSRPLSTTGLRSVHLSLLLSLFGIGGCVRLTRSYTKPTMREGIAPRKSLMSMPKLSRRVVLSSTLLMHCSPSGINTILATTQLLDFYGTSLLEWTPQFQNGQWRSSGTSGCRRSCRRNWTVLLATTVSCLRLISRTSPTFKPSKSPYGCTRRHHSCSLTRQAQVSRSAATTSPRGPTWMSGQWHVIPRCGTTHWSSGRSASWRRTLISRVATSGFFLSELAGECAPVRNLASTSPPSGTCCTTSSGHCRRAPSRRTSTWNPPDSSRSWESRCKLPSRARRRSCTRGSRLRC

SEQ ID NO: 231 - DNA, 789 bp, Cynodon dactylon
atggcgtccacggcaaccgaggcggcggcgcagcctgcggcggcggagcagcagcaggtcaacggcaacggcgagcagaagacgcgccactccgaggtcgggcacaagagcctgctcaagagcgacgacctctaccagtacatcctggagacgagcgtgtacccgcgggagccggagagcatgaaggagctccgtgaggtcaccgccaagcacccgtggaacctgatgacgacgtcggcggacgagggccagttcctcaacatgctgctcaagctcatcggcgccaagaagaccatggagatcggcgtctacaccggctactccctcctcgccaccgcgctcgccatccccgaggacggcacgatcttggccatggacatcaaccgcgagaactacgagctcggcctgccctgcatcgagaaggccggcgtcgcccacaagatcgacttccgcgagggaccggcgctccccctcctcgaccagctcctggaagacgaggccaaccacggctcgttcgacttcgtcttcgtcgacgccgacaaggacaactacctcaactaccacgagcggctgatgaagctcgtgaagacgggcggcctcgtcggctacgacaacacgctctggaacggctccgtcgtgctccccgccgacgcgcccatgcgcaagtacatccgctactaccgcgacttcgtgctcgagctcaacaaggcgctcgccgccgacgagcgcgtcgagatctgccagctccccgtcggagacggcatcaccctctgccgccgcgtcaagtga

SEQ ID NO: 232 - protein, 262 aa, Cynodon dactylon
MASTATEAAAQPAAAEQQQVNGNGEQKTRHSEVGHKSLLKSDDLYQYILETSVYPREPESMKELREVTAKHPWNLMTTSADEGQFLNMLLKLIGAKKTMEIGVYTGYSLLATALAIPEDGTILAMDINRENYELGLPCIEKAGVAHKIDFREGPALPLLDQLLEDEANHGSFDFVFVDADKDNYLNYHERLMKLVKTGGLVGYDNTLWNGSVVLPADAPMRKYIRYYRDFVLELNKALAADERVEICQLPVGDGITLCRRVK

SEQ ID NO: 233 - DNA, 788 bp, Cynodon dactylon
atgcgtccacggcaaccgaggcggcggcgcagcctgcggcggcggagcagcagcaggtcaacggcaacggcgagcagaagacgcgccactccgaggtcgggcacaagagcctgctcaagagcgacgacctctaccagtacatcctggagacgagcgtgtacccgcgggagccggagagcatgaaggagctccgtgaggtcaccgccaagcacccgtggaacctgatgacgacgtcggcggacgagggccagttcctcaacatgctgctcaagctcatcggcgccaagaagaccatggagatcggcgtctacaccggctactccctcctcgccaccgcgctcgccatccccgaggacggcacgatcttggccatggacatcaaccgcgagaactacgagctcggcctgccctgcatcgagaaggccggcgtcgcccacaagatcgacttccgcgagggaccggcgctccccctcctcgaccagctcctggaagacgaggccaaccacggctcgttcgacttcgtcttcgtcgacgccgacaaggacaactacctcaactaccacgagcggctgatgaagctcgtgaagacgggcggcctcgtcggctacgacaacacgctctggaacggctccgtcgtgctccccgccgacgcgcccatgcgcaagtacatccgctactaccgcgacttcgtgctcgagctcaacaaggcgctcgccgccgacgagcgcgtcgagatctgccagctccccgtcggagacggcatcaccctctgccgccgcgtcaagtga

SEQ ID NO: 234 - protein, 256 aa, Cynodon dactylon
MRPRQPRRRRSLRRRSSSRSTATASRRRATPRSGTRACSRATTSTSTSWRRACTRGSRRARSSVRSPPSTRGTRRRRTRASSSTCCSSSSAPRRPWRSASTPATPSSPPRSPSPRTARSWPWTSTARTTSSACPASRRPASPTRSTSARDRRSPSSTSSWKTRPTTARSTSSSSTPTRTTTSTTTSGSSRRAASSATTTRSGTAPSCSPPTRPCASTSATTATSCSSSTRRSPPTSASRSASSPSETASPSAAASS

SEQ ID NO: 235 - DNA, 1417 bp, Lolium perenne
  misc_feature (1)..(1): n is a, c, g, or t
  misc_feature (6)..(6): n is a, c, g, or t
  misc_feature (22)..(22): n is a, c, g, or t
  misc_feature (32)..(32): n is a, c, g, or t
  misc_feature (1179)..(1180): n is a, c, g, or t
  misc_feature (1387)..(1387): n is a, c, g, or t
  misc_feature (1408)..(1408): n is a, c, g, or t
naaggncccgtttctctgtggnactctgccgngttccattgcaatggttggtgttacacttgggcattggctgccttctgtggaaccagcatatgtcttcgccaggtgagcacaaaggctatatacagtggcattataaaacagggagtgacgcatttctgctgtgcacctattgtcatgaacaacctcatcaatgctcctgcaagtgaaaccttcctgccactcccccgtgtggtcaatgtcatgcwggcagswgcwscrccsacmmyayccyttctttccgccctgtctatccgaggttttcgtgtcacacacacttacggtctgtcggaaacctatggcccatcgacagtgtgcgsatggaagcctgagtgggacaatctcccactggaggagcgttcccgtctgcattgcaggcaaggcatcagatacactgcactggaaggcctcgatgtggttgatccgaaaaccatggatcctgtccctgctgatggcaagtcctatggagagatcgtgatgaggggcaacgctgtcatgaagggctacctgaagaaccccaaggccaatgctgaggcgttcacgcatggctggtaccactctggtgaccttggtgtaaagcaccccgatgggtacattgaagtcaaggaccggatgaaggacatcatcatctccggcggggagaacatcagcactctggaggtcgagaaggtggtgtacatgcacccagctgtcctcgaggcctctgtggtcgccagggccgacgagcgctggggggagtcaccatgcgcattcgttacattgaaggatggttctaacacctcaracgaggccgtgttggcgagcgacatcatgaagttctgccgggagaggatgccaggctactgggtgccaaagtcagtgatctttgggccattgcctaagacagcaacsggaaagatcaagaagcactgagctgagggcaaaggccaaggagcttggccctgtgaagaagagcaggatgtgagctctgttgctgagatgcacatatgtacagaggacaagtggtcsctagtcaataagggttatgcttggagataattcccatctgaatacttgcatgcataattaagttgttccgttaggaaatcaacggctcgttttcgttcaagaatggaaaagaaaagagaaaagtagaacaannagccttgtttcgatgctttgctgtgttggttttactttcagataaatatcccatggcttacgcagtgtagcctcttctgtttgtgatctgcagcaactggaagcagtaatagtacgcctagatgagcatagtgttctgtgtcccttgtgtgttcatctgttcaaatgcagaacgtgctatttcttcctgtctacacaatgctatctntacaaaaaacttagtttccgnaaaaaaaaa

SEQ ID NO: 236 - DNA, 691 bp, Lolium perenne
  misc_feature (3)..(3): n is a, c, g, or t
  misc_feature (8)..(8): n is a, c, g, or t
  misc_feature (24)..(24): n is a, c, g, or t
  misc_feature (34)..(34): n is a, c, g, or t
tgnaaggncccgtttctctgtggnactctgccgngttccattgcaatggttggtgttacacttgggcattggctgccttctgtggaaccagcatatgtcttcgccaggtgagcacaaaggctatatacagtggcattataaaacagggagtgacgcatttctgctgtgcacctattgtcatgaacaacctcatcaatgctcctgcaagtgaaaccttcctgccactcccccgtgtggtcaatgtcatgctggcaggagctgcaccgacaccatcccttctttccgccctgtctatccgaggttttcgtgtcacacacacttacggtctgtcggaaacctatggcccatcgacagtgtgcgcatggaagcctgagtgggacaatctcccactggaggagcgttcccgtctgcattgcaggcaaggcatcagatacactgcactggaaggcctcgatgtggttgatccgaaaaccatggatcctgtccctgctgatggcaagtcctatggagagatcgtgatgaggggcaacgctgtcatgaagggctacctgaagaaccccaaggccaatgctgaggcgttcgcgcatggctggtaccactccggtgaccttggtgtaaagcaccccgatgggtacattgaagtcaaggatcggatgaaggacatcatcatctccggcggggagaacatcag

SEQ ID NO: 237 - DNA, 678 bp, Lolium perenne
  misc_feature (6)..(6): n is a, c, g, or t
  misc_feature (8)..(8): n is a, c, g, or t
  misc_feature (17)..(18): n is a, c, g, or t
  misc_feature (25)..(25): n is a, c, g, or t
  misc_feature (31)..(31): n is a, c, g, or t
  misc_feature (294)..(294): n is a, c, g, or t
  misc_feature (675)..(675): n is a, c, g, or t
gcaggnanctgcaccgnncaccatncccttnctttccgccctgtctatccgagttttcgtgtcacacacacttacggtctgtcggaaacctatggcccatcgacagtgtgcgcatggaagcctgagtgggacaatctcccactggaggagcgttcccgtctgcattgcaggcaaggcatcagatacactgcactggaaggcctcgatgtggttgatccgaaaaccatggatcctgtccctgctgatggcaagtcctatggagagatcgtgatgaggggcaacgctgtcatgaanggctacctgaagaaccccaaggccaatgctgaggcgttcgcgcatggctggtaccactccggtgaccttggtgtaaagcaccccgatgggtacattgaagtcaaggatcggatgaaggacatcatcatctccggcggggagaacatcagcactctggaggtcgagaaggtggtgtacatgcacccagctgtcctcgaggcctctgtggtcgccagggctgacgagcgctggggggagtcaccatgcgcattcgttacattgaaggatggttctaacacctcagatgaggccgtgttggcgagcgacatcatgaagttctgtcgggagaggatgccaggctactgggtgccaaagtcagtgatctttgggccattgcctaanacc

SEQ ID NO: 238 - DNA, 468 bp, Lolium perenne
  misc_feature (4)..(4): n is a, c, g, or t
  misc_feature (13)..(13): n is a, c, g, or t
  misc_feature (92)..(92): n is a, c, g, or t
  misc_feature (245)..(245): n is a, c, g, or t
  misc_feature (329)..(329): n is a, c, g, or t
  misc_feature (463)..(463): n is a, c, g, or t
  misc_feature (468)..(468): n is a, c, g, or t
gttngaagcctgngtgggacaatctcccactggaggagcgttcccgtctgcattgcaggcaaggcatcagatacactgcactggaaggcctngatgtggttgatccgaaaaccatggatcctgtccctgctgatggcaagtcctatggagagatcgtgatgaggggcaacgctgtcatgaagggctacctgaagaaccccaaggccaatgctgaggcgttcacgcatggctggtaccactctggngaccttggtgtaaagcaccccgatgggtacattgaagtcaaggaccggatgaaggacatcatcatctccggcggggagaacatnagcactctggaggtcgagaaggtggtgtacatgcacccagctgtcctcgaggcctctgtggtcgccagggccgacgagcgctggggggagtcaccatgcgcattcgttacattgaaggatggttctaacacctnaaacn

SEQ ID NO: 239 - DNA, 465 bp, Lolium perenne
  misc_feature (2)..(3): n is a, c, g, or t
  misc_feature (34)..(34): n is a, c, g, or t
  misc_feature (86)..(86): n is a, c, g, or t
  misc_feature (92)..(92): n is a, c, g, or t
  misc_feature (245)..(245): n is a, c, g, or t
  misc_feature (385)..(385): n is a, c, g, or t
  misc_feature (465)..(465): n is a, c, g, or t
gnnggaagcctgagtgggacaatctcccactggnggagcgttcccgtctgcattgcaggcaaggcatcagatacactgcactgganggcctngatgtggttgatccgaaaaccatggatcctgtccctgctgatggcaagtcctatggagagatcgtgatgaggggcaacgctgtcatgaagggctacctgaagaaccccaaggccaatgctgaggcgttcacgcatggctggtaccactctggngaccttggtgtaaagcaccccgatgggtacattgaagtcaaggaccggatgaaggacatcatcatctccggcggggagaacatcagcactctggaggtcgagaaggtggtgtacatgcacccagctgtcctcgaggcctntgtggtcgccagggccgacgagcgctggggggagtcaccatgcgcattcgttacattgaaggatggttctaacacctcan

SEQ ID NO: 240 - DNA, 546 bp, Lolium perenne
  misc_feature (71)..(71): n is a, c, g, or t
  misc_feature (74)..(74): n is a, c, g, or t
  misc_feature (325)..(325): n is a, c, g, or t
  misc_feature (339)..(339): n is a, c, g, or t
  misc_feature (426)..(426): n is a, c, g, or t
  misc_feature (432)..(432): n is a, c, g, or t
  misc_feature (450)..(454): n is a, c, g, or t
  misc_feature (464)..(464): n is a, c, g, or t
  misc_feature (482)..(484): n is a, c, g, or t
  misc_feature (487)..(487): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (506)..(506): n is a, c, g, or t
  misc_feature (514)..(514): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (537)..(537): n is a, c, g, or t
tctggagagatcgtgatgaggggcaacgctgtcatgaagggctacctgaagaaccccaaggccaatgctgnggngttcacgcatggctggtaccactctggtgaccttggtgtaaagcaccccgatgggtacattgaagtcaaggaccggatgaaggacatcatcatctccggcggggagaacatcagcactctggaggtcgagaaggtggtgtacatgcacccagctgtcctcgaggcctctgtggtcgccagggccgacgagcgctggggggagtcaccatgcgcattcgttacattgaaggatggttctaacacctcaaacnaggccgtgttggcnagcgacatcatgaagttctgccgggagaggatgccaggctactgggtgccaaagtcagtgatctttgggccattgcctaagacagcnaccggnaagatcaagaagcactgnnnnnagggcaaagnccaaggagcttggccctnnnaanaanancangatgtgagctntgttgctnanatncacatntgnacagagganaagtggtcc

SEQ ID NO: 241 - DNA, 730 bp, Lolium perenne
  misc_feature (492)..(493): n is a, c, g, or t
  misc_feature (700)..(700): n is a, c, g, or t
  misc_feature (721)..(721): n is a, c, g, or t
tagcccctggaggtggagaaggtggtgtacatgcacccggctgtcctcgaggcatctgtggtcgccagggctgacgagcgctggggggagtcgccgtgtgcattcatcacattgaaggaaggttctaacacctcggacgaggctgcgttggcgagcgacatcatgaagttctgccgtgagaggatgccaggctactgggtgccaaagtcggtgatctttgggccattgccaaagacagcaacgggaaagatcaagaagcactgagctgagggcaaaggccaaggagcttggccctgtgaagaagagcaggatgtgagctctgttgctgagatgcacatatgtacagaggacaagtggtcgctagtcaataagggttatgcttggagataattcccatctgaatacttgcatgcataattaagttgttccgttaggaaatcaacggctcgttttcgttcaagaatggaaaagaaaagagaaaagtagaacaannagccttgtttcgatgctttgctgtgttggttttactttcagataaatatcccatggcttacgcagtgtagcctcttctgtttgtgatctgcagcaactggaagcagtaatagtacgcctagatgagcatagtgttctgtgtcccttgtgtgttcatctgttcaaatgcagaacgtgctatttcttcctgtctacacaatgctatctntacaaaaaacttagtttccgnaaaaaaaaa

SEQ ID NO: 242 - DNA, 771 bp, Lolium perenne
  misc_feature (3)..(3): n is a, c, g, or t
tcntggtcacgctcttcgtgcgcttcgggcgtcgcagtacgcgccacctgcttgtgacaatgtctacctggccgcgctgcccatgttccacgtctacggcctctctctcttcgccgtgggcctcctctcgctcggcacgccggtcgtggtcatgaggaggttcgacgtaggcgaggcgctcagggccatccacaggttcaaggtcacgcacttgccgctcgtgccgcccatcatggcggcgctgctcagagccaagtccgcaggcgccttgtcgttggagtccttggtacaggtctccagcggtgcagctccgctcggcggcaaactcgttcaagactttctccaggctttcccacacgtcgatttcattcagggctatggcatgacagaatcgacggctgtgggaactcgcggatttaatacttcaaagcacaagaagcatgcctctgtaggtcttttagccccaaacatgcatgcgaaaatacttgatgtggaaacgggcttctgtttacctccaggctcttgtggcgaattgtggctccatgggccagctataatgaaaggttacttgaatgatgaagatacatgcgcaagaagtgatggctggttgcagactggcgatcttgcttactttgattcatatgggtacatttacatagtgggccgtttgaaagacacaattaagtacaaaggatttcagatagctccggctgaccttgaagctgttttggtccagcaccctgaaattgttgatgttgctgtaacatccgc

SEQ ID NO: 243 - DNA, 606 bp, Lolium perenne
  misc_feature (32)..(32): n is a, c, g, or t
tttatgttgttgatagacttaaagagctgatnagtacaaggttttagattgcacctgctgagcttgaaggattacttctatctcatccagagattctagatgctgtcgttatcccgtttcctgatgctgaagctggagaagttcctatagcttacgttgtccggtcaacttcgagttcattgactgaaattgatgtgcagaaatttattgaaactcaggtcacgtactacaaaaggttgaagagggttacattcgtggacagcgtaccaaagtcagtttcaggcaagattttgagaagagagctcatcgccaaagtcagatcggaacaagccagattgtccaagctgtagcaaatctgctgcttctttctgttccagagcaattcttgctgctaaattttaaagcttcacaactctacaatgtcaggaggtttacaaattcctgagctggagctttcactttgtgccctgtgtgtgttgcaacatgagtttcaatctcaacattgtacagaagtttgtatgtgacaaaaatcattgttcggcaaatgtaccagtgttctatatactatatatacagggaatgcaaaaaaaaatgaatatgaatggg

SEQ ID NO: 244 - DNA, 521 bp, Lolium perenne
gtcctcgcctacgagcgccccgacgcccgcggccgctacctctgcatcggggccgtgctgcaccgcgcgcacttcctaaagcttctcaaggacctcttcccgcagtactccttcaccgccaagtgcgaagacgacggcaagcccatggcgaagccgtacaagttctccaccagaggctcagggacctgggataaaattcactccgctggcggaaagtttgtacgagaccgtgacgtgcctgcaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaaa

SEQ ID NO: 245 - DNA, 360 bp, Lolium perenne
  misc_feature (7)..(7): n is a, c, g, or t
  misc_feature (360)..(360): n is a, c, g, or t
gttctcnaccagaggctcagggacctgggataaaattcactccgctggcggaaagtttgtacgagaccgtgacgtgcctgcaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaan

SEQ ID NO: 246 - DNA, 371 bp, Lolium perenne
  misc_feature (24)..(25): n is a, c, g, or t
aagccgtacaagttctccaccagnngctcagggacctgggataaaattcactccgctggcggaaagtttgtacgagaccgtgacgtgcctgcaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaaa

SEQ ID NO: 247 - DNA, 520 bp, Lolium perenne
  misc_feature (515)..(515): n is a, c, g, or t
gtcctcgcctacgagcgccccgacgcccgcggccgctacctctgcatcggggccgtgctgcaccgcgcgcacttcctaaagcttctcaaggacctcttcccgcagtactccttcaccgccaagtgcgaagacgacggcaagcccatggcgaagccgtacaagttctccaccagaggctcagggacctgggataaaattcactccgctggcggaaagtttgtacgagaccgtgacgtgcctgcaaaaaatggccacctgcctctgcccgctcccgtggcgccaaagcgtgcatacctataatatactcaagacacggccgggatcgacaagccaagaaacagaggattctcccgaggttcaccatggaattgtgtatttcagaaagtttgaattcttattttttttattatgaaggaatacggataaccaatactgtataccagaggcaagtgtaacaatgtaaatagtcgtgtaaatctgttcaagattgaatgataaagtattttttgcaaaanaaaaa

SEQ ID NO: 248 - DNA, 777 bp, Lolium perenne
gccgggcgcgagctctacttcacgctgccgagatcctgcagaagctgctgggctcggtgccgctggtgcatgtcgacgacgtctgcgcggcgcacatcttctgcatggagcagccttccctctccggccggttcctctgcgctgccgcctatccaacagtccacgacatcctggaccactacgggagcaagtttcctcacctggacctcctcaaagagactgatgacgtacctgtgagggtgcaatcggagagagacaagctgggcgagctgggttttaggtacaaatacaagatggagcagatactagacgaaagcatcagctgcgcggtgaggttgggcgctctggatgcatccaggctcagcgtgcagcagaagtgatgaactccggctgtgtggagtgcacagcaagtgatcacagtgatgtcctgcacttcacagccatacaaagtagtacatttgttaagagaaggaagccgacacataaataagtaaacaatgcatcgttagcaaacgattgacagcttactgtttggtttttgctatagcaactagagaaacttgcagttgtgaattaccagtgctatgtgctcccttctctccgatagttcatttacatggagaaaattgcagacttgaggttgcctgacttagcaaagacgtagagattgattttgcttttctctgttgtagtactcttttttctttctctcgttgaggttggacagctaatggctcttttgatgcaatgacgaatgttattttcccaaaaaaaaaa

SEQ ID NO: 249 - DNA, 326 bp, Lolium perenne
  misc_feature (30)..(30): n is a, c, g, or t
gtagtacatttgttaagagaggaagccgancataaataagtaaacaatgcatcgttagcaaacgattgacagcttactgtttggtttttgctatagcaactagagaaacttgcagttgtgaattaccagtgctatgtgctcccttctctccgatagttcatttacatggagaaaattgcagacttgaggttgcctgacttagcaaagacgtagagattgattttgcttttctctgttgtagtactcttttttctttctctcgttgaggttggacagctaatggctcttttgatgcaatgacgaatgttattttcccaaaaaaaaaa

SEQ ID NO: 250 - DNA, 626 bp, Lolium perenne
gccgggcgcgagctctacttcacgctgccgagatcctgcagaagctgctgggctcggtgccgctggtgcatgtcgacgacgtctgcgcggcgcacatcttctgcatggagcagccttccctctccggccggttcctctgcgctgccgcctatccaacagtccacgacatcctggaccactacgggagcaagtttcctcacctggacctcctcaaagagactgatgacgtacctgtgagggtgcaatcggagagagacaagctgggcgagctgggttttaggtacaaatacaagatggagcagatactagacgaaagcatcagctgcgcggtgaggttgggcgctctggatgcatccaggctcagcgtgcagcagaagtgatgaactccggctgtgtggagtgcacagcaagtgatcacagtgatgtcctgcacttcacagccatacaaagtagtacatttgttaagagaaggaagccgacacataaataagtaaacaatgcatcgttagcaaacgattgacagcttactgtttggtttttgctatagcaactagagaaacttgcagttgtgaattaccagtgctatgtgctcccttctctccgatagttcatttacatggagaaaa

SEQ ID NO: 251 - DNA, 774 bp, Lolium perenne
  misc_feature (18)..(18): n is a, c, g, or t
  misc_feature (42)..(42): n is a, c, g, or t
  misc_feature (774)..(774): n is a, c, g, or t
ggcaatcttcacctgttnaggctgacgtgctagactgcgagncgctaacacgtgcgttcgagggatgcgagggggtcttccacctcgccactccggtgcccgaagataagattattgatcctgaggcagatgcatacatgcagtcagaagtaatggctccggcagttaagggcacttcaaatgtgctaaaggtttgcttggctatgaaggttcagaaagtcatcgtattgtcctccactgctgctgttgattttaacccgaattggcctcaaggtagactcaaagatgagagttgctggtcggacaaagagttctgcaaggagaatgaggactggtattctgttgccaagattgtggctgaacaggcatcccgtgaatatgcagagaaaaatggattgaccgtggttacactttgccctcctttagtttttggaccattattacaacctatggtgaataccagtagcaaattcttaatctatgttataaaaggaggtcctgacgtgatgaacaacaagctgtggcacatggtagacgtgcgtgatgtggccgatgccttactgcttgtgtacgagaaggcgcaatcatccgggagatatatatgcgcacctaataacatcttcacgaaggatttggtggacctgctgaagaagatgtacccaaagtacagctatgtgaacaacatcatcgatgtggaacacaaagcgccgataacatcgcagaagctgagggatctgggctgggagccgcggaagctcaaagagacgctctggn

SEQ ID NO: 252 - DNA, 614 bp, Lolium perenne
  misc_feature (38)..(38): n is a, c, g, or t
  misc_feature (534)..(534): n is a, c, g, or t
  misc_feature (573)..(573): n is a, c, g, or t
  misc_feature (578)..(578): n is a, c, g, or t
  misc_feature (582)..(582): n is a, c, g, or t
gtttccgacgcctacctcgtcagcttcgcgaggcccanatggccgccgccatggactcgctggactacatcatcgacaccgtgcccgtcaagcacccgctcgagccctacctcgcgctcctcaagatggacggcaagctcgtcctcatgggcgtcatcggcgagccgctcagcttcgtgtcccccatggtcatgctcgggaggaagaccatcacgggcagcttcatcgggagcatcgaggagaccgaggaggtgctcaggttctgcgtcgaaaaggggctcacctcaatcgaggtcgtcaagatggactacctcaaccaggcgctcgagaggctcgagcgcaacgacgtcaggtaccgcttcgtcgtcgacgtcgcagggagcaacatcgacgacaccgccgcatgattcacttggcaacgacgagcgaacctacattgagcgcgacaatttccgtgacatatgctcctcaacttggttcaatacatgtttgtgaactgtgtgaatgtgtttccgtcttctatcagagattcanagtgtgcatgttagtttcaataggaagaaatgtttggtntaagncccngccctaataataacggattttgctacccaaaa

SEQ ID NO: 253 - DNA, 417 bp, Lolium perenne
  misc_feature (4)..(4): n is a, c, g, or t
gganaccgccgacgtcgaggtcgtcaagatggactacgtcaacaccgccatcgagcggctagagaagaacgacgtggggtaccgcttcgtcatcgacgtcgccggcagccacctgcagggcaccgccgcttaacttgtgctacacaatgtggacgcgcgctcgtttggtccagaaaaaggttcgccggctcacagccacatgaacaagtcaatgagtcgttggtgtgttgtttatcttcattccacatatgggacgcagttccagattttcatgtcaaataattgcgtcgtgtgcggttgtcaagactcaaataggagaaaaaaagactcgtgatttcgttttgcaagatgtattggtattttgatagtcactttactattttgtgaattgtgatcaagctttgataaaaaaaaaaa

SEQ ID NO: 254 - DNA, 1387 bp, Lolium perenne
  misc_feature (2)..(2): n is a, c, g, or t
  misc_feature (5)..(6): n is a, c, g, or t
  misc_feature (861)..(861): n is a, c, g, or t
  misc_feature (1100)..(1100): n is a, c, g, or t
  misc_feature (1117)..(1117): n is a, c, g, or t
  misc_feature (1192)..(1192): n is a, c, g, or t
  misc_feature (1220)..(1220): n is a, c, g, or t
  misc_feature (1262)..(1262): n is a, c, g, or t
  misc_feature (1267)..(1267): n is a, c, g, or t
  misc_feature (1288)..(1288): n is a, c, g, or t
  misc_feature (1311)..(1311): n is a, c, g, or t
  misc_feature (1336)..(1336): n is a, c, g, or t
  misc_feature (1349)..(1349): n is a, c, g, or t
  misc_feature (1385)..(1385): n is a, c, g, or t
gngtnnaccacgacaagaccacacggaractyttkgacaactccctcccttcagccgcatccgctcttggttttactggcaccgaagatacagaaggcgcctcgtcggctggttcctggttctcccaaatcccgatcaccttcctcaggcttagttggtatggctgttgaatccgagagctgcaactgcgatgcctgggcagcaagagatccttctggaatactctccccctacagattcacccgtaggactgtacaacataccgatgtttctttgagaatcacgcattgcggagtctgttatgctgatgttgtctggacgagaaataagcacaatgactctgtgtaccctttggtccctgggcatgagattgctggagttgtaactgaggttggttcagacgttgatggctttaaagtgggggaccatgtggctgttgggacatatgtgaattcatgccgtgactgcgagaactgcaatagcttccttgagaaccactgctcaaaatttgttttcactttcaatggtgttgattcagatggtactgtcacaaagggaggatattccagtcacattgtagttcatgaacggtactgccacaaaatacctgatgggtacccactggaaaaggcagcacctttagtttgtgctggaatcactgtgtatactccaatgatgcgacataacatgaatcaaccgggaaagtcacttggtgtcgttgggcttggtgggttgggtcacatggcagtaaaatttgggaaagcctttggattgaaggttacagtttttagcacaagtgaatcaaagagagatgaagctataagccttcttggtgcagataattttgtgatatcatcaggngaaaaacagatggagtcccttaaaaattccatgcacttcattgttgatactgcctctggtaaccatccattcgacccttatcttgcgcttctgaaagttggtggcgtaatggtgctagtccgctttccaggagaaatcagagtgcagcctgcaacacttaacctagtgcacggagtttatcttggtagtgtaacccggaggcacaaaggatacccaagagatgataaacttctgtgcgnaaacaaaatctatccanatactgagttgataaagatggattacatcaccgaggctctcagaagcttggtaaccgtgaccgtcagggaccggnttgtaatccacataaagagctctttcangtgatatctttgcagttggcattatttgaatctttattgaanaatgnggaataagttgaatcttctangctatgccactgggttgtaatanaaggcatcctctggaattttctggnatacttttccttnccggcaattctagtcatactttccaaaaaaaaaaanga

SEQ ID NO: 255 - DNA, 618 bp, Lolium perenne
  misc_feature (2)..(2): n is a, c, g, or t
  misc_feature (5)..(6): n is a, c, g, or t
  misc_feature (13)..(14): n is a, c, g, or t
  misc_feature (16)..(16): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (36)..(36): n is a, c, g, or t
  misc_feature (43)..(43): n is a, c, g, or t
  misc_feature (51)..(51): n is a, c, g, or t
  misc_feature (54)..(54): n is a, c, g, or t
  misc_feature (87)..(87): n is a, c, g, or t
  misc_feature (94)..(94): n is a, c, g, or t
gngtnnaccacgnnangaccacacgnannctnttgnacaactncctccctncanccgcatccgctcttggttttactggcaccgaanatacagnaggcgcctcgtcggctggttcctggttctcccaaatcccgatcaccttcctcaggcttagttggtatggctgttgaatccgagagctgcaactgcgatgcctgggcagcaagagatccttctggaatactctccccctacagattcacccgtaggactgtacaacataccgatgtttctttgagaatcacgcattgcggagtctgttatgctgatgttgtctggacgagaaataagcacaatgactctgtgtaccctttggtccctgggcatgagattgctggagttgtaactgaggttggttcagacgttgatggctttaaagtgggggaccatgtggctgttgggacatatgtgaattcatgccgtgactgcgagaactgcaatagcttccttgagaaccactgctcaaaatttgttttcactttcaatggtgttgattcagatggtactgtcacaaagggaggatattccagtcacattgtagttcatgaacggtactgccacaaaatacctgatgggtat

SEQ ID NO: 256 - DNA, 618 bp, Lolium perenne; identical to SEQ ID NO: 255
  misc_feature (2)..(2): n is a, c, g, or t
  misc_feature (5)..(6): n is a, c, g, or t
  misc_feature (13)..(14): n is a, c, g, or t
  misc_feature (16)..(16): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (36)..(36): n is a, c, g, or t
  misc_feature (43)..(43): n is a, c, g, or t
  misc_feature (51)..(51): n is a, c, g, or t
  misc_feature (54)..(54): n is a, c, g, or t
  misc_feature (87)..(87): n is a, c, g, or t
  misc_feature (94)..(94): n is a, c, g, or t

SEQ ID NO: 257 - DNA, 704 bp, Lolium perenne
  misc_feature (2)..(2): n is a, c, g, or t
  misc_feature (4)..(5): n is a, c, g, or t
  misc_feature (9)..(9): n is a, c, g, or t
  misc_feature (12)..(12): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (29)..(29): n is a, c, g, or t
  misc_feature (62)..(62): n is a, c, g, or t
  misc_feature (68)..(68): n is a, c, g, or t
gnannactntgncaactncctncctncanccgcatccgctcttggttttactggcaccgaanaacagnaggcgcctcgtcggctggttcctggttctcccaaatcccgatcaccttcctcaggcttagttggtatggctgttgaatccgagagctgcaactgcgatgcctgggcagcaagagatccttctggaatactctccccctacagattcacccgtaggactgtacaacataccgatgtttctttgagaatcacgcattgcggagtctgttatgctgatgttgtctggacgagaaataagcacaatgactctgtgtaccctttggtccctgggcatgagattgctggagttgtaactgaggttggttcagacgttgatggctttaaagtgggggaccatgtggctgttgggacatatgtgaattcatgccgtgactgcgagaactgcaatagcttccttgagaaccactgctcaaaatttgttttcactttcaatggtgttgattcagatggtactgtcacaaagggaggatattccagtcacattgtagttcatgaacggtactgccacaaaatacctgatgggtacccactggaaaaggcagcacctttagtttgtgctggaatcactgtgtatactccaatgatgcgacataacatgaatcaaccgggaaagtcacttggtgtcgttgggcttggtg

SEQ ID NO: 258 - DNA, 776 bp, Lolium perenne
  misc_feature (11)..(11): n is a, c, g, or t
  misc_feature (17)..(17): n is a, c, g, or t
taacacgaganaacacngagatctattgacaactcctcctcagccgcatccgctcttggttttactggcaccgaagatacagaggcgcctcgtcggctggttcctggttctcccaaatcccgatcaccttcctcaggcttagttggtatggctgttgaatccgagagctgcaactgcgatgcctgggcagcaagagatccttctggaatactctccccctacagattcacccgtaggactgtacaacataccgatgtttctttgagaatcacgcattgcggagtctgttatgctgatgttgtctggacgagaaataagcacaatgactctgtgtaccctttggtccctgggcatgagattgctggagttgtaactgaggttggttcagacgttgatggctttaaagtgggggaccatgtggctgttgggacatatgtgaattcatgccgtgactgcgagaactgcaatagcttccttgagaaccactgctcaaaatttgttttcactttcaatggtgttgattcagatggtactgtcacaaagggaggatattccagtcacattgtagttcatgaacggtactgccacaaaatacctgatgggtacccactggaaaaggcagcacctttagtttgtgctggaatcactgtgtatactccaatgatgcgacataacatgaatcaaccgggaaagtcacttggtgtcgttgggcttggtgggttgggtcacatggcagtaaaatttgggaaagcctttggattgaaggttacagtttt

SEQ ID NO: 259 - DNA, 772 bp, Lolium perenne
  misc_feature (91)..(91): n is a, c, g, or t
  misc_feature (245)..(246): n is a, c, g, or t
  misc_feature (485)..(485): n is a, c, g, or t
  misc_feature (502)..(502): n is a, c, g, or t
  misc_feature (577)..(577): n is a, c, g, or t
  misc_feature (605)..(605): n is a, c, g, or t
  misc_feature (647)..(647): n is a, c, g, or t
  misc_feature (652)..(652): n is a, c, g, or t
  misc_feature (673)..(673): n is a, c, g, or t
  misc_feature (696)..(696): n is a, c, g, or t
  misc_feature (721)..(721): n is a, c, g, or t
  misc_feature (734)..(734): n is a, c, g, or t
  misc_feature (770)..(770): n is a, c, g, or t
tacccgctgcaaaaggcagcacctttagtttgtgctggaatcactgtgtatactccaatgatgcgacataacatgaatcaaccgggaaagncacttggtgtcattgggcttggtgggttgggtcacatggcagtaaaatttgggaaagcctttggattgaaggttacagtttttagcacaagtgaatcaaagagagatgaagctataagccttcttggtgcagataattttgtgatatcatcagnngaaaaacagatggagtcccttaaaaattccatgcacttcattgttgatactgcctctggtaaccatccattcgacccttatcttgcgcttctgaaagttggtggcgtaatggtgctagtccgctttccaggagaaatcagagtgcagcctgcaacacttaacctagtgcacggagtttatcttggtagtgtaacccggaggcacaaaggatacccaagagatgataaacttctgtgcgnaaacaaaatctatccanatactgagttgataaagatggattacatcaccgaggctctcagaagcttggtaaccgtgaccgtcagggaccggnttgtaatccacataaagagctctttcangtgatatctttgcagttggcattatttgaatctttattgaanaatgnggaataagttgaatcttctangctatgccactgggttgtaatanaaggcatcctctggaattttctggnatacttttccttnccggcaattctagtcatactttccaaaaaaaaaaanga

SEQ ID NO: 260 - DNA, 959 bp, Lolium perenne
  misc_feature (84)..(84): n is a, c, g, or t
gaggttgtgaatgtgtattcccacggcttctcccttttatcacaatgtcaaagatcccaaggctgaattacttgacccagcagncaatggaacactcaatgttctgcgttcctgcaagaaagcttctattaaaagagtgattgtaacgtcatcaatggctgctgttggttacaatgggaaaccaaaaactcctgatgtagtagttgatgagacatggttttcacttgcagagctctgtgaaaagaatcagcaatggtatgtgctatccaagacccttgctgaggaggctgcatggaagttctcaaaagataatggatttgaaatagttacaataaacccagcaatggtcatcggtcccctgttgcagcctacattgaatactagtgctgaagcaatattgaagctaattaatggatcatcttctacgtaccctaatttcagctttggatggataaatgttaaagatgttgccttggcacatattctagcatatgaagttccttcagcaaatggaagatactgcatggttgaaagagttgctcaccactcagagcttgtcgagctcatacacaaaatgtatcccgacattcccgtgccaaacaagtgtgctgatgaccagccattcgtcccaacctaccaagtctcaaaggacaaggtaagaagtttgggaatggagctgactcccctggatacaagcatcaaggagactatcgagagcctgaaagagaagggattttttacttttgagtcgagccacctgtgaagcagcaaaactagtttcggcatcactagtagcagacaccatgtgctgtgcatmtgcatatgmcgtttatgtgggyggttttatgggttgtgccgtggygaactgaaataaatgagacattgtgatttgtyggtccgttatgattccgtggatttgagttgatacwtttayaamcrrwamacgtgcaaaaaaaaaa

SEQ ID NO: 261 - DNA, 794 bp, Lolium perenne
  misc_feature (84)..(84): n is a, c, g, or t
  misc_feature (730)..(730): n is a, c, g, or t
gaggttgtgaatgtgtattcccacggcttctcccttttatcacaatgtcaaagatcccaaggctgaattacttgacccagcagncaatggaacactcaatgttctgcgttcctgcaagaaagcttctattaaaagagtgattgtaacgtcatcaatggctgctgttggttacaatgggaaaccaaaaactcctgatgtagtagttgatgagacatggttttcacttgcagagctctgtgaaaagaatcagcaatggtatgtgctatccaagacccttgctgaggaggctgcatggaagttctcaaaagataatggatttgaaatagttacaataaacccagcaatggtcatcggtcccctgttgcagcctacattgaatactagtgctgaagcaatattgaagctaattaatggatcatctactacgtaccctaatttcagctttggatggataaatgttaaagatgttgccttggcacatattctagcatatgaagttccttcagcaaatggaagatactgcatggttgaaagagttgctcaccactcagagcttgtcaagctcatacaaaaaatgtatcccgacattcccgtgccaaacaagtgtgctgatgaccagccattcgtcccaatctaccaagtctcaaaggacaagggaagaagtttgggaatggagctgactcccctggatacaagcatcaaggagactatcgagagcctgaaagagaanggattttttacttttgagtcgagccacctgtgaagcagcaaaactagtttcggcatcactagta

SEQ ID NO: 262 - DNA, 598 bp, Lolium perenne
  misc_feature (592)..(592): n is a, c, g, or t
ggtcatcggtcccctgttgcagcctacttgaatactagtgctgaagcaatattgaagctaattaatggatcatcttctacgtaccctaatttcagctttggatggataaatgttaaagatgttgccttggcacatattctagcatatgaagttccttcagcaaatggaagatactgcatggttgaaagagttgctcaccactcagagcttgtcgagctcatacacaaaatgtatcccgacattcccgtgccaaacaagtgtgctgatgaccagccattcgtcccaacctaccaagtctcaaaggacaaggtaagaagtttgggaatggagctgactcccctggatacaagcatcaaggagactatcgagagcctgaaagagaagggattttttacttttgagtcgagtcacctgtgaagcagcaaaactagtttcggcatcactagtagcagacaccatgtgctgtgcatctgcatatgccgtttatgtgggtggttttatgggttgtgccgtggtgaactgaaataaatgagacattgtgatttgtcggtccgttatgattccgtggatttgagttgatacttttacaaanaaaaaa

SEQ ID NO: 263 - DNA, 599 bp, Lolium perenne
  misc_feature (593)..(593): n is a, c, g, or t
ggtcatcggtcccctgttgcagcctacattgaatactagtgctgaagcaatattgaagctaattaatggatcatcttctacgtaccctaatttcagctttggatggataaatgttaaagatgttgccttggcacatattctagcatatgaagttccttcagcaaatggaagatactgcatggttgaaagagttgctcaccactcagagcttgtcgagctcatacacaaaatgtatcccgacattcccgtgccaaacaagtgtgctgatgaccagccattcgtcccaacctaccaagtctcaaaggacaaggtaagaagtttgggaatggagctgactcccctggatacaagcatcaaggagactatcgagagcctgaaagagaagggattttttacttttgagtcgagtcacctgtgaagcagcaaaactagtttcggcatcactagtagcagacaccatgtgctgtgcatctgcatatgccgtttatgtgggtggttttatgggttgtgccgtggtgaactgaaataaatgagacattgtgatttgtcggtccgttatgattccgtggatttgagttgatacttttacaaanaaaaaa

SEQ ID NO: 264 - DNA, 310 bp, Lolium perenne
  misc_feature (3)..(3): n is a, c, g, or t
  misc_feature (301)..(302): n is a, c, g, or t
ggnaaggtaagaagtttgggaatggagctgactcccctggttacaagcatcaaggagactatcgagagcctgaaagagaagggattttttacttttgagtcgagccacctgtgaagcagcaaaactagtttcggcatcactagtagcagacaccatgtgctgtgcatatgcatatgacgtttatgtgggcggttttatgggttgtgccgtggcgaactgaaataaatgagacattgtgatttgttggtccgttatgattccgtggatttgagttgatacatttataaccggtacacgtgcnnaaaaaaaa

SEQ ID NO: 265 - DNA, 311 bp, Lolium perenne
  misc_feature (42)..(42): n is a, c, g, or t
  misc_feature (91)..(91): n is a, c, g, or t
gttttagggaaacagtttgggaattttgctggctccaccggntacaagcatcaaggagactatcgagagcctttaagagaagggatttttnacttttgagtcgagccacctgtgaagcagcaaaactagtttcggcatcactagtagcagacaccatgtgctgtgcatatgcatatgacgtttatgtgggcggttttatgggttgtgccgtggcgaactgaaataaatgatacattgtgatttgttggtccgttatgattccgtggatttgagttgatacatttataaccggtacacgtgcaaaaaaaaaa

SEQ ID NO: 266 - DNA, 745 bp, Lolium perenne
  misc_feature (740)..(745): n is a, c, g, or t
gcaacggaayygacttggtgacaataaacccagctayggtccttggccccttactgcagcccacactcaacacaagtgctgaaataatcaagtatctaataagtggttcacctgtttatcttaatattagctttggttgggtgaatgtgaaggatgttgctctggcacatgtccttgcatgtgaggttccttcagcaagtggaagatactgcgtggttgacagagttatccacttctcggaagttgtcaaaatcatccgtgaaatgtatccttctcttccggtgcctgagaagtgtgccgatgaccagccattggctccaacataccaggtctcaaaggacaagataaagagcttgggaatcgagttgacccccttcgagacgaccctcggggaaaccatagaaagcttgaaggagaaaggctttgtcaccttctaaactcaattgtactagtaactcgacaaattatctgcggcagataagagmwaataaatctcaaggtaggtaccagatggtattcgcttgcactttccagtgtaagtgccactcaacagggacaatgcaggacaccaatttttattttgtaaaccctacctccttttcaagaggtattttagtatattgtaatctgaatgatggctttactgtttctcaattatggttgcgtcggcccgtggcgtaagggcgtcggcgcgtcctgaaacttccctattgctaatcgctggttgactggtttaaaannnnnn

SEQ ID NO: 267 - DNA, 695 bp, Lolium perenne
  misc_feature (408)..(408): n is a, c, g, or t
  misc_feature (624)..(624): n is a, c, g, or t
  misc_feature (661)..(661): n is a, c, g, or t
  misc_feature (665)..(668): n is a, c, g, or t
  misc_feature (674)..(674): n is a, c, g, or t
  misc_feature (681)..(681): n is a, c, g, or t
  misc_feature (687)..(692): n is a, c, g, or t
  misc_feature (695)..(695): n is a, c, g, or t
gcaacggaattgacttggtgacaataaacccagctatggtccttggccccttactgcagcccacactcaacacaagtgctgaaataatcaagtatctaataagtggttcacctgtttatcttaatattagctttggttgggtgaatgtgaaggatgttgctctggcacatgtccttgcatgtgaggttccttcagcaagtggaagatactgcgtggttgacagagttatccacttctcggaagttgtcaaaatcatccgtgaaatgtatccttctcttccggtgcctgagaagtgtgccgatgaccagccattggctccaacataccaggtctcaaaggacaagataaagagcttgggaatcgagttgacccccttcgagacgaccctcggggaaaccatagaaagcntgaaggagaaaggctttgtcaccttctaaactcaattgtactagtaactcgacaaattatctgcggcagataagagataataaatctcaaggtaggtaccagatggtattcgcttgcactttccagtgtaagtgccactcaacagggacaatgcaggacaccaatttttattttgtaaaccctacctccttttcaagaggtattttagtatattgnaatctgaatgatggctttactgtttctcaattatggntgcnnnngcccgnggcgtangggcgnnnnnncgn

SEQ ID NO: 268 - DNA, 742 bp, Lolium perenne
  misc_feature (737)..(742): n is a, c, g, or t
acggaaccgacttggtgacaataaacccagctacggtccttggccccttactgcagcccacactcaacacaagtgctgaaataatcaagtatctaataagtggttcacctgtttatcttaatattagctttggttgggtgaatgtgaaggatgttgctctggcacatgtccttgcatgtgaggttccttcagcaagtggaagatactgcgtggttgacagagttatccacttctcggaagttgtcaaaatcatccgtgaaatgtatccttctcttccggtgcctgagaagtgtgccgatgaccagccattggctccaacataccaggtctcaaaggacaagataaagagcttgggaatcgagttgacccccttcgagacgaccctcggggaaaccatagaaagcttgaaggagaaaggctttgtcaccttctaaactcaattgtactagtaactcgacaaattatctgcggcagataagagcaaataaatctcaaggtaggtaccagatggtattcgcttgcactttccagtgtaagtgccactcaacagggacaatgcaggacaccaatttttattttgtaaaccctacctccttttcaagaggtattttagtatattgtaatctgaatgatggctttactgtttctcaattatggttgcgtcggcccgtggcgtaagggcgtcggcgcgtcctgaaacttccctattgctaatcgctggttgactggtttaaaannnnnn

SEQ ID NO: 269 - DNA, 509 bp, Lolium perenne
  misc_feature (7)..(7): n is a, c, g, or t
  misc_feature (501)..(501): n is a, c, g, or t
ggatcanaaacacggtgtctgcaaacatccccctgacccctctcttcgggctgctcaagcccaacggcaagatggtcatggtcggcctccccgagaagcccatcgagattcctccctttgttctagttgccaccaataagagcctcgccgggagcctcatcggcggcatgagcgacacgcaggagatgctggacctcgcggcgaagcacggcgtgaccgccgacatcgaggtggtcggcgcggagtatgtgaacacggccttggagcgccttgccaagaacgacgtcaggtatcgcttcgtcatcgacatcggcaacaccctcgacaaggctgcggccaccaccgagtgaacgtactcagcactgcttacgatctacgttggtccactgttagtgctccgtagtaaacaataaacgatataaactcttgtcatctggtggtgcattggtgtagacatggttgtttccgaggaaactgagttgaaggatggatggcttgtcnaaaaaaaa

SEQ ID NO: 270 - DNA, 551 bp, Lolium perenne
  misc_feature (4)..(4): n is a, c, g, or t
  misc_feature (81)..(81): n is a, c, g, or t
  misc_feature (403)..(403): n is a, c, g, or t
aacnaacaatctctcaacactccccaatcccacagccacagaagccacctaccaccgctcgaccgatcgacgcgcgatggnggtcctcctcctggagaaggccctgctggggctcttcgcggcggcggtggtggccatcgccgtcgcaaagctcaccggcaagcgcttccgcctcccgcccggcccctccggcgcccccatcgtcggcaactggctccaggtcggcgacgacctcaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatnttcaccggcaacggccaggacatggtcttcaccgtctacggcgaccactggcgcaagatgcgccggatcatgaccgtccccttctttaccaacaaggtggtggcgcaaaacccctgggctgggaggaggaggccaggctcgtggtgga

SEQ ID NO: 271 - DNA, 802 bp, Lolium perenne
  misc_feature (81)..(81): n is a, c, g, or t
  misc_feature (479)..(479): n is a, c, g, or t
  misc_feature (495)..(495): n is a, c, g, or t
  misc_feature (572)..(572): n is a, c, g, or t
  misc_feature (582)..(582): n is a, c, g, or t
  misc_feature (622)..(622): n is a, c, g, or t
  misc_feature (650)..(650): n is a, c, g, or t
  misc_feature (656)..(656): n is a, c, g, or t
  misc_feature (662)..(662): n is a, c, g, or t
  misc_feature (666)..(666): n is a, c, g, or t
  misc_feature (740)..(740): n is a, c, g, or t
  misc_feature (749)..(749): n is a, c, g, or t
  misc_feature (754)..(754): n is a, c, g, or t
  misc_feature (772)..(772): n is a, c, g, or t
  misc_feature (778)..(778): n is a, c, g, or t
  misc_feature (782)..(782): n is a, c, g, or t
tagaaaccctgtggtcgatcgagtggggcattgccgagctggtgaaccacccggacgtccagtccaagctccgcgacgagntggccgccgtgctgggcgccgacgtggcggtgacggagccggacctcgagcgcctcccgtacctgcagtccgtcgtgaaggagacgctccgcctccgcatggccatcccgctgctcgtgccgcacatgaacctcagcgacgccaagctcgccggctacgacatccccgccgagtccaagatcctcgtcaacgcatggttcctcgccaacgaccccaagcggtgggtgcgcgccgacgagttcaggccggagcgcttcctcgaggaggagaaggccgtcgaggcccacggcaacgacttccgcttcgtgcccttcggcgtcggccgccggagctgccccgggatcgtcctcgcgctgcccatcatcggcattacgctcggacgccttgtgcagaacttncagctgctgccgccgnccgggcaggacaagatcgacaccaccgagaagcccggacagttcagcaaccagatccttaagcacgccaccgtcgtntgcaagccgntcgagggctaaaattttttatttgatcatatggaggcttntgaattgcgtgttttgtgcatgcatgcntgaacncttgtngccnagagatcatcttttgacccattgggatggggtattttcctttttttttgggctttttatttttacttaagttgnattttttgntgggnctttattgtgaggggggnatgttngaanatttactatgttgggggata

SEQ ID NO: 272 - DNA, 766 bp, Lolium perenne
  misc_feature (5)..(5): n is a, c, g, or t
  misc_feature (24)..(24): n is a, c, g, or t
ggtcntcgagtgggcgctagccgngtcgtgaccaccctgacgtgcagcgcaaggtccgcgccgagatcaaggatgtgctcggcgacgacgagcccatcaccgagtccaacatcagcaggctgccgtacctgcaggccgtcatcgaggaggcgctgcggctgcactgccccatcccgctgctcgtcccccacatgaacctcgaggacgccaagctcggccggtacgccatccccaagggctccaaggtcgtcgtcaacgcgtggtggctggcaaacaacccggagctgtgggagaagccggaggagttcaggccggagaggttcctgggcgaggagagcagcgtggacgccgccgtcggcggcaaggtggacttccggttcctcccgttcggcatgggacgccgcagctgccccggtatcatcctcgcgctgcccatcctcgccctcatcgtcgggaagctcgtgaggagcttcgagatggtgcctccgccaggcgtagacaagctcgacatgagcgagaaaggcgggcagttcagcctgcacattgccaaccactccgtcgtcgccttccaccccatctctccatgaagtgggattcatatgatcagattgtttctagatacaatacaagaacagcggaatttcgtccgattaagggggctctacataatacttttcggcattgaggaatgtattttcgaaatataaatgttatttataattcatttgacaaatatgaggtatgcttctctgcttgaaaaaaaaaa

SEQ ID NO: 273 - DNA, 1960 bp, Lolium perenne
gaattcactagtgattaagcagtggtaacaacgcagagtacgcgggagatcaaccaacaatctctcaacactccccaatcccacagtcacagaagccacctaccaccgctcgaccgatcgacgcgcgatggaggtcctcctcctggagaaggccctgctggggctcttcgcggcggcggtggtggccatcgccgtcgcaaagctcaccggcaagcgcttccgcctcccgcccggcccctccggcgcccccatcgtcggcaactggctccaggtcggcgacgacctcaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgcctgggctgggaggaggaggccaggctcgtggtggaggacgtcaaggccgacccggcgtccgccaccgccggcaccgtgatccgccgaaggctgcagctcatgatgtacaacgacatgttccgcatcatgttcgaccgcaggttcgagtccgtcgacgacccgctcttcaacaagctcaaggccatgaacgccgagcgcagcatcctctcccagagcttcgactacaactacggcgacttcatccccatcctcagacccttcctccgcaagtacctcaaccggtgcaccaacctcaagaccaagaggatgaagctattcgaggaccacttcgtcgctgaccgaaagaaggcgctggagcagaatggggagatcaggtgcgccatggaccacatcctggaggccgaaaggaagggggagatcaaccacgacaacgtcctctacatcgtcgagaacatcaacgtcgctgccatcgagacaaccctgtggtcgatcgagtggggcattgccgagctggtgaaccacccggacgtccagtccaagttccgcgacgagatggccgccgtgctgggcgccgacgtggcggtgacggagccggacctcgagcgcctcccgtacctgcagtccgtcgtgaaggagacgctccgcctccgcatggccatcccgctgctcgtgccgcacatgaacctcagcgacgccaagctcgccggctacgacatccccgccgagtccaagatcctcgtcaacgcatggttcctcgccaacgaccccaagcggtgggtgcgcgccgacgagttcaggccggagcgcttcctcgaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgacaccaccgagaagcccggacagttcagcaaccagatcctcaagcacgccaccgtcgtctgcaagccgctcgaggcctagaattttctatttgatcatatggaggcttctgacatgcgtgtctgtgcatgcatgcgtgaacgctggtgccgagagatcgatctatgcacgcatgtgatgtgtattttcctttttttgtgcttttattttacttagttgcatttttgttggtcttcatgtgaggcgtcatgttgtagatttactatgttggtgataatgatgtaaaacttcttcactgcgaagtgagacgattactcatcagtacacacactcagatggccctaaaaaaaaaaaaaaaaaaaaaaaaaaaaaagtactctgcgttgttaccactgcttaatcgaattc

SEQ ID NO: 274 - DNA, 1113 bp, Lolium perenne
  misc_feature (2)..(2): n is a, c, g, or t
  misc_feature (1106)..(1107): n is a, c, g, or t
tnggactgccgatcactcgagtcagcaaaacaacaacccaatcatcccgcccagatctcacgcggttccttcctccacctaaacaccggcaatggcgaccacggcggctgatgccacgaccacggtgcccaaggagcagaccaccaccaacggcgccgccagcggtgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacgacaacacgctctggaacggatccgtcgtgctccccgacgacgygcccatgcgcaagtacattcgctactaccgcgacttcgtcctcgtgctcaacaaggagctcgccgcagacgaccgcgtcgagatctgccagctccccgtcggagacggcatcaccctctgccgccgctgcaaagtgattgtctgattgatgactgctcgcgcgcgcgccgscccctccgcgtccgcaccatggatgctggacaagaattaattaattattccccattttgcctttcttgctttcttctgtatcttcttggaaacaaatattgtccctttatgtacgtatatcaaatttatatccagacaaataawatkkmwmmtatraawtgatgacccgatattttattaannaaaaaa

SEQ ID NO: 275 - DNA, 557 bp, Lolium perenne
  misc_feature (284)..(284): n is a, c, g, or t
  misc_feature (377)..(377): n is a, c, g, or t
  misc_feature (398)..(398): n is a, c, g, or t
  misc_feature (427)..(427): n is a, c, g, or t
  misc_feature (488)..(488): n is a, c, g, or t
  misc_feature (509)..(509): n is a, c, g, or t
  misc_feature (545)..(545): n is a, c, g, or t
  misc_feature (556)..(557): n is a, c, g, or t
gccatcactcgagtcagcaaaacaacaacccaatcatcccgctcagatctcacgcgtttccttcctccagctaaacaccggcaatggcgaccacggcggctgatgccacggccacggtgcccaaggagcagaccaccaccaacggcgccgccagcggtgccgagcaggtcacccgccactccgaggtcggccacaagagcctgctccagagcgacgcgctctaccagtacatcctggagaccaccgtgtacccgcgcgagcacgagtgcatgaagcagctccgngaggacaccgccaaccacccatggaacctgatgaccacgtcggcggacgagggccagttcctcaacctgctcatcaagctcatcggcgccaanaagaccatggagatcggcgtntacaccggctactccctcctcgccaccgngctcgccatcccagaggacggcacgatcttggccatggacatcaaccgcgagaactacganaccatcggcaagccgtgcatngagaaggccggcgtcgcacacaatatcgacttccgngagggccccgnn

SEQ ID NO: 276 - DNA, 758 bp, Lolium perenne
  misc_feature (2)..(3): n is a, c, g, or t
  misc_feature (41)..(41): n is a, c, g, or t
  misc_feature (697)..(697): n is a, c, g, or t
tnngtttgccgatcactcgagtcagcattcaacaacccaancatcccgcccagatctcacgcggttccttcctccacctaaacaccggcaatggcgaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacnacaacacgctctggaacggatccgtcgtgctccccgacgacgtgcccatgcgcaagtacat

SEQ ID NO: 277 - DNA, 774 bp, Lolium perenne
  misc_feature (2)..(2): n is a, c, g, or t
  misc_feature (20)..(20): n is a, c, g, or t
  misc_feature (28)..(28): n is a, c, g, or t
  misc_feature (245)..(245): n is a, c, g, or t
  misc_feature (431)..(431): n is a, c, g, or t
  misc_feature (637)..(637): n is a, c, g, or t
  misc_feature (655)..(655): n is a, c, g, or t
  misc_feature (766)..(766): n is a, c, g, or t
gnactgccatcagtcgactnagcaagtnagcccaatcatccagcccagatctcgcgcgtttccttcctccagctaaagacccgcaatggcgaccacggcggctgatgccacggccacggtggccaaggagcagaccaccactaacggcgccgagcaggtcacccgccactccgaggtcggccacaagagcctgctccagagcgacgcgctctaccagtacatcctggagaccaccgtgtacccgngcgagcacgagtgcatgaagcagctccgcgaggacaccgccaaccacccatggaacctcatgaccacgtcggcggacgagggccagttcctcaacctgctcatcaagctcatcggcgcaaagaagaccatggagatcggcgtctacaccggctactccctcctcgccaccgcgctcgccatcccanaagacggaaccatcttggccatggacatcaaccgcgagaactacgagaccatcggcaagccgtgcatcgagaaggccggcgtcgcgcacaagatcgacttccgcgagggccccgcgctcccggtcctggacgcgctgctcgacgacgaggccaaccacggctccttcgacttcgtcttcgtcgacgccgacaaggacaactacctnaactaccaccagcgcctnatgaagctcgtcagggtcggcggcctcatcggctacgacaacacgctctggaacggatccgtcgtgctccccgccgacgcgcccatgcgcaagtacattcgctactaccgngactttgt

SEQ ID NO: 278 - DNA, 765 bp, Lolium perenne
  misc_feature (13)..(14): n is a, c, g, or t
  misc_feature (667)..(667): n is a, c, g, or t
acgccatagtcgnntcagcaagaagcccaatcatccagcccagatctcgcgcgtttccttcctccagctaaagacccgcaatggcgaccacggcggctgatgccacggccacggtggccaaggagcagaccaccactaacggcgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctcatgaccacgtcggcggacgagggccagttcctcaacctgctcatcaagctcatcggcgcaaagaagaccatggagatcggcgtctacaccggctactccctcctcgccaccgcgctcgccatcccagaagacggaaccatcttggccatggacatcaaccgcgagaactacgagaccatcggcaagccgtgcatcgagaaggccggcgtcgcgcacaagatcgacttccgcgagggccccgcgctcccggtcctggacgcgctgctcgacgacgaggccaaccacggctccttcgacttcgtcttcgtcgacgccgacaaggacaactacctcaactaccaccagcgcctcatgaagctcgtcagggncggcggcctcatcggctacgacaacacgctctggaacggatccgtcgtgctccccgccgacgcgcccatgcgcaagtacattcgttactaccgcgact

SEQ ID NO: 279 - DNA, 777 bp, Lolium perenne
  misc_feature (85)..(85): n is a, c, g, or t
  misc_feature (91)..(91): n is a, c, g, or t
  misc_feature (368)..(368): n is a, c, g, or t
  misc_feature (418)..(418): n is a, c, g, or t
  misc_feature (593)..(593): n is a, c, g, or t
  misc_feature (656)..(656): n is a, c, g, or t
  misc_feature (677)..(677): n is a, c, g, or t
  misc_feature (773)..(773): n is a, c, g, or t
  misc_feature (775)..(775): n is a, c, g, or t
gactgccatactcgagtcagcaaaacaacaacccaatcatcccgcccagatctcacgcggttccttcctccacctaaacaccggnaatggngaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaanaagaccatggagatcggcgtctacaccggctactccctcctcgccaccgngctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggntccttcgacttcgtcttcgtcgacgccgacaaggacaactacctcaactaccaccagcgcctnatgaagctcgtcagggtcggnggactcatcggctaccacaacacgctctggaacggatccgtcgtgctccccgacgacgtgcccatgcgcaagtacattcggtactaccgcgacttngntc

SEQ ID NO: 280 - DNA, 792 bp, Lolium perenne
  misc_feature (18)..(18): n is a, c, g, or t
  misc_feature (84)..(84): n is a, c, g, or t
  misc_feature (90)..(90): n is a, c, g, or t
  misc_feature (367)..(367): n is a, c, g, or t
  misc_feature (417)..(417): n is a, c, g, or t
  misc_feature (592)..(592): n is a, c, g, or t
  misc_feature (637)..(637): n is a, c, g, or t
  misc_feature (655)..(655): n is a, c, g, or t
  misc_feature (772)..(772): n is a, c, g, or t
gacgccatcactcgagtngcaaaacaacaacccaatcatcccgcccagatctcacgcggttccttcctccacctaaacaccggnaatggngaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaanaagaccatggagatcggcgtctacaccggctactccctcctcgccaccgngctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggntccttcgacttcgtcttcgtcgacgccgacaaggacaactacctnaactaccaccagcgcctnatgaagctcgtcagggtcggcggactcatcggctacgacaacacgctctggaacggatccgtcgtgctccccgacgacgtgcccatgcgcaagtacattcgctactaccgcgacttngtcctcgtgctcaacaagga

SEQ ID NO: 281 - DNA, 793 bp, Lolium perenne
  misc_feature (692)..(692): n is a, c, g, or t
gactgccatcctcgagtcagcaaacaacaacccaatcatcccgcccagatctcacgcggttccttcctccacctaaacaccggcaatggcgaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacnacaacacgctctggaacggatccgtcgtgctccccgacgacgtgcccatgcgcaagtacatccgctactaccgcgacttcgtcctcgtgctcaacaaggag

SEQ ID NO: 282 - DNA, 457 bp, Lolium perenne
  misc_feature (450)..(451): n is a, c, g, or t
cttaactaccaccagcgcctcatgaagctcgtcagggtcggcggactcatcggctacgacaacacgctctggaacggatccgtcgtgctccccgacgacgcgcccatgcgcaagtacatccgctactaccgcgacttcgtcctcgtgctcaacaaggagctcgccgcagacgaccgcgtcgagatctgccagctccccgtcggagacggcatcaccctctgccgccgcgcaaagtgattgtctgattgatgacgctcgcgcgcgcgccgccccctccgctccgcaccatggatgcggacaagaattaattaattattccccattttgcctttcttgctttcttctgtatcttcttggaaacaaatattgtccctttatgtacgtatatcaaatttatatccagacaaataatatttctcctataaaatgatgacccgatattttattaannaaaaaa

SEQ ID NO: 283 - DNA, 361 bp, Lolium perenne
  misc_feature (2)..(2): n is a, c, g, or t
  misc_feature (10)..(10): n is a, c, g, or t
  misc_feature (89)..(89): n is a, c, g, or t
  misc_feature (135)..(135): n is a, c, g, or t
  misc_feature (237)..(237): n is a, c, g, or t
  misc_feature (246)..(246): n is a, c, g, or t
  misc_feature (318)..(318): n is a, c, g, or t
  misc_feature (329)..(329): n is a, c, g, or t
  misc_feature (332)..(332): n is a, c, g, or t
  misc_feature (338)..(339): n is a, c, g, or t
  misc_feature (343)..(343): n is a, c, g, or t
  misc_feature (350)..(350): n is a, c, g, or t
  misc_feature (357)..(357): n is a, c, g, or t
  misc_feature (360)..(361): n is a, c, g, or t
gnttccgtcncgctccccgacgacgcgcccatgcgcaagtacatccgctactaccgcgacttcgctctcgtgctcaacaaggagctcgncgcagacgaccgcgtcgagatctgccagctccccgtcggagacggnatcaccctctgccgccgctgcaaagggattgtctgattgatgactgctcgcgcgcgcgccggcccctccgcgtccgcaccatggatgctggacaagaattanttaattatnccccattttgcctttcttgctttcttctgtatcttcttggaaacaaatattgtccctttatgtacgtatatnaaatttatatncanacaaannaaanggaaaanatgaatngann

SEQ ID NO: 284 - DNA, 1103 bp, Lolium perenne
ggttggactcgygttctctctctctytctgcgtgacgcttgttgtgtgcatattgtagaacggtgcgagtcttgagcggcggcggcggttccttcttcgccgggctagcagcagcagttgcggcgcggccatggcttcgaacggggaggtcaaggacatccacaacagcgaaagcaccaagacggcctcctcaagagtgacagccctctacgagtacatgctgaagacgatggtgtacccacgggagaacgagttcctgcgggagctccgcctcatcaccaaggagcacacctatgggttcatgtcgtcgccgccggacgagggcctgctcctctcgctgctcctgaaggtcatgggcgccaagaacaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggagtcgcgcacaaggtcgagttccgcgagggccctgccggccccatcctcgatgggctcatcgccaacgaagaagacgaggcgagcttcgacttcgccttcgtcgacgccgacaagcccaactacggcaagtaccacgagcagctgctgcggctggtgcgtgtcggcggcgtgctcgcctacgacaacacgctctggggcggcaccgtcgccatgccgccaggcacgcccatgtccgacctcgacaccaggttctccgccgccatcagggacctcaacgccaagctcgccgccgacccgcgcatcgaggtctgccagctcgccatcgcagacggcgtcaccatctgccgccgcctcgtctgatcccgtcgccccggtgtgacgatcactctgcgtgccacttcttattaagtttttttttcatcagcgcgcgctagcgtgtgaagaagcgtctgctggttttcaattatttcaataagattttgggagctgagtggaactttgagtgcgatcaaagagttgttgtactgatgctatagttgtactgtacttgttccgaaatactatggcgactttatgtcagttcaggttaaaaaaaaaa

SEQ ID NO: 285 - DNA, 628 bp, Lolium perenne
  misc_feature (2)..(2): n is a, c, g, or t
  misc_feature (88)..(88): n is a, c, g, or t
  misc_feature (97)..(97): n is a, c, g, or t
  misc_feature (111)..(111): n is a, c, g, or t
  misc_feature (295)..(295): n is a, c, g, or t
  misc_feature (361)..(361): n is a, c, g, or t
  misc_feature (441)..(441): n is a, c, g, or t
  misc_feature (469)..(469): n is a, c, g, or t
  misc_feature (475)..(477): n is a, c, g, or t
  misc_feature (547)..(547): n is a, c, g, or t
  misc_feature (575)..(575): n is a, c, g, or t
  misc_feature (596)..(596): n is a, c, g, or t
  misc_feature (628)..(628): n is a, c, g, or t
gngactcgtgttctctctctctctctgcgtgacgcttgttgtgtgcatattgtagaacggtgcgagtcttgagcggcggcggcggttncttcttcgncgggctagcagcancagttgcggcgcggccatggcttcgaacggggaggtcaaggacattcacaacagcgaaagcaccaagacagcttcctcaagagtgacagccctctacaagtacatgctgaagacgatggtgtacccacgggagaacgagttcctgcgggagctccgcctcatcaccaaggagcacacctatggnttcatgtcgtcaccgccggacgagggcctgctcctctcgctgctcctgaaggtcatgggcgccaanaacaccatcgaggtcggcgtcttcaccggctgctccgtcctcgccacggcgctcgccatcccggacgatggcaaggtggncgccatcgacgtcagcagggagtacttngacctnnncctccccgtcatcaagaaggccggagtcgcgcacaaggtcgagttccgcgagggccctgccggccccatnctcgatgggctcatcgccaacgaaaaanacgaggggagcttcgacttcncattcgtcgacgccgacaagcccaactacggn

SEQ ID NO: 286 - DNA, 693 bp, Lolium perenne
  misc_feature (34)..(34): n is a, c, g, or t
  misc_feature (549)..(549): n is a, c, g, or t
  misc_feature (571)..(571): n is a, c, g, or t
  misc_feature (600)..(600): n is a, c, g, or t
  misc_feature (637)..(637): n is a, c, g, or t
  misc_feature (669)..(669): n is a, c, g, or t
  misc_feature (682)..(682): n is a, c, g, or t
  misc_feature (693)..(693): n is a, c, g, or t
gccgaactcgtgttctctctctctctccgcgtgncgcttgttttgtgcatattgtagaacggtgcgagtcttgagcggcggcggcggttccttcttcgccgggctagcagcagcagtagcggcgcggccatggcttcgaacggggaggtcaaggacatccacaacagcgaaagcaccaagacgctcctcaagagtgacgccctctacgagtacatgctgaagtcgatggtgtacccacgggagaacgagttcctgcgggagctccgcctcatcaccaaggagcacacctatgggttcatgtcgtcgccgccggacgagggccagctgttgtcgctgttgctcaaggtgatgggcgccaagaagaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggcgtcgcgcacaaggtgggcttccgcgagggccccgccggcccgatcctngacgggctcatcgccgacgaanaacacgaggcgagctttgacttcgccttngtggacgccgacaagcccaactatggcaagtaccacnagcagctgctgcggctggtgcgtgtcggcggngtgctcgcctacnacaacacgctn

SEQ ID NO: 287 - DNA, 773 bp, Lolium perenne
  misc_feature (7)..(7): n is a, c, g, or t
  misc_feature (10)..(10): n is a, c, g, or t
gttggantcncgttctctctctctttctgcgtgacgcttgttgtgtgcatattgtagaacggtgcgagtcttgagcggcggcggcggttccttcttcgccgggctagcagcagcagttgcggcgcggccatggcttcgaacggggaggtcaaggacatccacaacagcgaaagcaccaagacgctcctcaagagtgacgccctctacgagtacatgctgaagacgatggtgtacccacgggagaacgagttcctgcgggagctccgcctcatcaccaaggagcacacctatgggttcatgtcgtcgccgccggacgagggcctgctcctctcgctgctcctgaaggtcatgggcgccaagaacaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggagtcgcgcacaaggtcgagttccgcgagggccctgccggccccatcctcgatgggctcatcgccaacgaagaagacgaggggagcttcgacttcgcattcgtcgacgccgacaagcccaactacggcaagtaccacgagcagctgctgcggctggtgcgtgtcggcggcgtgctcgcctacgacaacacgctctggggcggctcagtggccatgcccgccgacacgccgctcacggaggacgacatccaggtaagggacgccatgagggagtt

SEQ ID NO: 288 - DNA, 789 bp, Lolium perenne
gtttttagtcacgttctctctctctttctgcgtgacgcttgttgtgtgcatattgtagaacggtgcgagtcttgagcggcggcggcggttccttcttcgccgggctagcagcagcagttgcggcgcggccatggcttcgaacggggaggtcaaggacatccacaacagcgaaagcaccaagacgctcctcaagagtgacgccctctacgagtacatgctgaagacgatggtgtacccacgggagaacgagttcctgcgggagctccgcctcatcaccaaggagcacacctatgggttcatgtcgtcgccgccggacgagggcctgctcctctcgctgctcctgaaggtcatgggcgccaagaacaccatcgaggtcggcgtcttcaccggctgctccgtcctcgccacggcgctcgccatcccggacgatggcaaggtggtcgccatcgacgtcagcagggagtacttcgacctcggcctccccgtcatcaagaaggccggagtcgcgcacaaggtcgagttccgcgagggccctgccggccccatcctcgatgggctcatcgccaacgaagaagacgaggggagcttcgacttcgcattcgtcgacgccgacaagcccaactacggcaagtaccacgagcagctgctgcggctggtgcgtgtcggcggcgtgctcgcctacgacaacacgctctggggcggctcagtggccatgcccgccgacacgccgctcacggaggacgacatccaggtaagggacgccatgagggagttcaacgcaaggatcgc

SEQ ID NO: 289 - DNA, 532 bp, Lolium perenne
  misc_feature (3)..(4): n is a, c, g, or t
  misc_feature (21)..(21): n is a, c, g, or t
ggnngacggtgccgcgccctnagacttcgccttcgtcgagccgacaagcccaactacgtcaagtaccacgagcagctgcttcgcctcgtccgcgtcggcggcaccatcatctacgacaacacgctctggggcggcaccgtcgccatgccgccaggcacgcccatgtccgacctcgacaccaggttctccgccgccatcagggacctcaacgccaagctcgccgccgacccgcgcatcgaggtctgccagctcgccatcgcagacggcgtcaccatctgccgccgcctcgtctgatcccgtcgccccggtgtgacgatcactctgcgtgccacttcttattaagtttttttttcatcagcgcgcgctagcgtgtgaagaagcgtctgctggttttcaattatttcaataagattttgggagctgagtggaactttgagtgcgatcaaagagttgttgtactgatgctatagttgtactgtacttgttccgaaatactatggcgactttatgtcagttcaggttaaaaaaaaaa

SEQ ID NO: 290 - DNA, 532 bp, Lolium perenne; identical to SEQ ID NO: 289
  misc_feature (3)..(4): n is a, c, g, or t
  misc_feature (21)..(21): n is a, c, g, or t

SEQ ID NO: 291 - DNA, 412 bp, Lolium perenne
  misc_feature (403)..(403): n is a, c, g, or t
tctacgacaacacgctctggggcggtaccgtcgccatgccgccaggcacgcccatgtccgacctcgacaccaggttctccgccgccatcagggacctcaacgccaagctcgccgccgacccgcgcatcgaggtctgccagctcgccatcgcagacggcgtcaccatctgccgccgcctcgtctgatcccgtcgccccggtgtgacgatcactctgcgtgccacttcttattaatttttttttcatcagcgagcgctagcgtgtgaagaatcgtctgctggttttcaaatatttcaataagattttgggagctgagtggaactttgagtgcgatcaaagagttgttgtactgctgctatagttgtactgtacttgttccgaaatactatggcgactttatgtcnaaaaaaaaa

SEQ ID NO: 292 - DNA, 689 bp, Lolium perenne
  misc_feature (6)..(6): n is a, c, g, or t
  misc_feature (10)..(10): n is a, c, g, or t
  misc_feature (25)..(25): n is a, c, g, or t
  misc_feature (74)..(74): n is a, c, g, or t
  misc_feature (81)..(81): n is a, c, g, or t
  misc_feature (83)..(83): n is a, c, g, or t
  misc_feature (606)..(606): n is a, c, g, or t
gcaaanaacntacttgtttccaggnaacatgccgcccgccggcaaaccaacaacacagaatggcggccaccggnagccggnanaagacaaaaaggcggtcgccgggagcagcctccacagcaagaccctcctcaaaagcgagcagctctaccagtacatactggagtccacggtgtttccgctcgagcccgactgcctacgcgagctgcgcgtcgccaccacgacccaccccatggctggcatggcggcgtccccagaccaagtgcagctgtttggcctcctgatcgagatgctcggcgccaaaaacgccatcgaggtcggcgtgttcaccggatactcgctgctcgccaccgccctcgccctccccgatgacggcaaggttgtggccatcgatgtcagccgcgagagctacgaccagatagggtcgcccgtggtcgagaaggccggcatggcgcacaagatcgacttccgtgtggggtttgcactgccggtgctggatcagctggtggcggaggatggcaccagtggcaagttcgacttcgcgttcgtggacgcggacaaggccaacttccaccactaccacgagcggctgctgcggctggtcanggtcgggggcctcatcgcctacgacaacacgctgtggggcggctctgtggccacgcccgatgacgagacgctgtcggagcggc

SEQ ID NO: 293 - DNA, 1161 bp, Lolium perenne
gaattcactagtgattaagcagtggtaacaacgcagagtacgcggggaacgccaatcagtcgactcagcaagacagcccaatcatccagcccagatctcgcgcgtttccttcctccagctaaagacccgcaatggcgaccacggcggctgatgccacggccacggtggccaaggagcagaccaccactaacggcgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctcatgaccacgtcggcggacgagggccagttcctcaacctgctcatcaagctcatcggcgcaaagaagaccatggagatcggcgtctacaccggctactccctcctcgccaccgcgctcgccatcccagaagacggaaccatcttggccatggacatcaaccgcgagaactacgagaccatcggcaagccgtgcatcgagaaggccggcgtcgcgcacaagatcgacttccgcgagggccccgcgctcccggtcctggacgcgctgctcgacgacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtcgtgctccccgccgacgcgcccatgcgcaagtacatccgctactaccgcgacttggtcctcgagctcaacaaggccctcgccgccgacgaccgcgtcgagatctgccagcttcccgtcggcgacggcatcacgctctgccgccgcgccaagtgattgtctgattgatgacgcgcgcgcgcgccgccccctttgctccgctccatggatgcggacaagaattaattaattattattccccattttgccgttcttgctttcttctgtatcttctcggaaattgtccctttatgtacgtatacaaatttatatccagacaaataatattactcctataaaaaaaaaaaaaaaaaaaaaaaaaaaaagtactctgcgttgttaccactgcttaatcgaattc

SEQ ID NO: 294 - DNA, 1199 bp, Lolium perenne
gaattcactagtgattaagcagtggtaacaacgcagagtacgcggggaacgccaatcactcgagtcagcaaaacaacaacccaatcatcccgcccagatctcacgcggttccttcctccacctaaacaccggcaatggcgaccacggcggctgatgccacgaccacggtgcccaaggagcagaccaccaccaacggcgccgagcaggtcacccgccactccgaggtcggacacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaagacggaaccatcttggccatggacatcaaccgcgagaactacgagaccatcggcaagccgtgcatcgagaaggccggcgtcgcgcacaagatcgacttccgcgagggccccgcgctcccggtgctcgacgcgctgctcgaagacgaggccaaccacggctccttcgacttcgtcttcgtcgacgccgacaaggacaactacctcaactaccaccagcgcctcatgaagctcgtcagggtcggcggactcatcggctacgacaacacgctctggaacggatccgtcgtgctccccgacgacgtgcccatgcgcaagtacatccgctactaccgcgacttcgtcctcgtgctcaacaaggagctcgccgcagacgaccgcgtcgagatctgccagctccccgtcggagacggcatcaccctctgccgccgcgcaaagtgattgtctgattgatgacgctcgcgcgcgcgccgtcccctccgctccgcaccatggatgcggacaagaattaattaattattccccattttgcctttcttgctttcttctgtatcttcttggaaacaaatattgtccctttatgtacgtatatcaaatttatatccagacaaataatatttctcctataaaatgatgacccgatattttattgtcaaaaaaaaaaaaaaaaaaaaaaaaaaaaaaagtactctgcgttgttaccactgcttaatcgaattc

SEQ ID NO: 295 - DNA, 1486 bp, Lolium perenne
gkywactatagctcgggtctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagagcgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacaccatcctcatgaagtggatcctccacgactggagcgaccagcactgcgccacgctgctcaagaactgctacgacgcgctgccggcgcacggcaaggtcgtgctcgtccagtgcatcctgccggtcaacccggaggccaatcccagctcgcagggggtcttccacgtcgacatttacatgctcgcgcacaaccccggcggcagggaaaggtacgagagggagttccaggctctcgccgggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttgttgaatatacgagtaaattgaagtgaaaaaaaaaaaaaaaaaaaaaaa

SEQ ID NO: 296 - DNA, 101 bp, Lolium perenne
tgttctgaaaaggttgcgtatgttgtatacttgtatgtgatgtaatgagatgatttctctcctttgttgaatatacgagtaaattgaagtgaaaaaaaaaa

SEQ ID NO: 297 - DNA, 400 bp, Lolium perenne
  misc_feature (8)..(8): n is a, c, g, or t
  misc_feature (30)..(30): n is a, c, g, or t
ggagttcnaggctctcgccggggagccggntcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgaggtgatttctctcctttgttgaatatacgagtaaattgaagtcaaaaaaaaaa

SEQ ID NO: 298 - DNA, 403 bp, Lolium perenne
  misc_feature (9)..(9): n is a, c, g, or t
  misc_feature (25)..(25): n is a, c, g, or t
  misc_feature (32)..(32): n is a, c, g, or t
  misc_feature (296)..(296): n is a, c, g, or t
gttagttcnaggctctcgccggggnagccggnttcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattantaacgatgttctgaaaaggttgcgtatgttgtatacttgtatgtgatgtaatgaggtgatttctctcctttgttgaatatacgagtaaattgaagtcaaaaaaaaaa

SEQ ID NO: 299 - DNA, 421 bp, Lolium perenne
  misc_feature (13)..(13): n is a, c, g, or t
  misc_feature (83)..(83): n is a, c, g, or t
  misc_feature (414)..(414): n is a, c, g, or t
  misc_feature (416)..(416): n is a, c, g, or t
  misc_feature (418)..(419): n is a, c, g, or t
  misc_feature (421)..(421): n is a, c, g, or t
gctttggagaggncgagagggagttccaggctctcgccaggggagccggattcaccggcgtcaagtccacgtacatctacggnaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttggtgaatatacgagtaaattgaagcgaananannan

SEQ ID NO: 300 - DNA, 383 bp, Lolium perenne
  misc_feature (8)..(8): n is a, c, g, or t
  misc_feature (14)..(14): n is a, c, g, or t
  misc_feature (30)..(31): n is a, c, g, or t
  misc_feature (82)..(82): n is a, c, g, or t
  misc_feature (251)..(251): n is a, c, g, or t
gggttttncggatncccggcgtcaagtccnnttacatctatgccaacgcgtgggccatcgagttcaccaagtagatgagatncctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtgggngatctgctcggaatgtaccattaataacgatgttctgaaaaggttgcgtatgttgtatactcgtatgtgatgtaatgagatgatttctctcctttgttgaatatacgagtaaattgaagtggaaaaaaaaaa

SEQ ID NO: 301 - DNA, 419 bp, Lolium perenne
  misc_feature (34)..(34): n is a, c, g, or t
  misc_feature (36)..(37): n is a, c, g, or t
  misc_feature (45)..(45): n is a, c, g, or t
  misc_feature (48)..(48): n is a, c, g, or t
  misc_feature (410)..(410): n is a, c, g, or t
gttacatgctcgcgcacaaccccggcggcagggnanngtacgagnggnagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctccnaaaaaaaaa

SEQ ID NO: 302 - DNA, 1455 bp, Lolium perenne
ggcacgagcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggcctcggcaccctcgtcgatgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacaccatcctcatgaagtggatcctccacgactggagcgaccagcactgcgccacgctgctcaagaactgctacgacgcgctgccggcgcacggcaaggtcgtgctcgtccagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcgggatgtaccattaataacgatgttctgaaaaggttgcgtatgttgaaaacttgtatgtgatgtaatgagatgatttctctcctttgttgaaaaaacgagtaaattgaagtgaaaaaaaaaaaaaaaaaaaaaaa

SEQ ID NO: 303 - DNA, 789 bp, Lolium perenne
  misc_feature (1)..(1): n is a, c, g, or t
  misc_feature (55)..(55): n is a, c, g, or t
  misc_feature (118)..(118): n is a, c, g, or t
  misc_feature (299)..(299): n is a, c, g, or t
  misc_feature (328)..(328): n is a, c, g, or t
  misc_feature (375)..(375): n is a, c, g, or t
  misc_feature (591)..(591): n is a, c, g, or t
  misc_feature (594)..(594): n is a, c, g, or t
  misc_feature (696)..(696): n is a, c, g, or t
  misc_feature (699)..(699): n is a, c, g, or t
  misc_feature (719)..(719): n is a, c, g, or t
  misc_feature (744)..(744): n is a, c, g, or t
nctatagctcgggtctctcgctcacaccaaaatcgcccaccagcaccagcatctntcgatcggcagacgcatagatcgatgggctccaccgccgccgacatggccgcgtccgccgacnaggacgcgtgcatgttcgccctccagctcgcttcctcgtcggtcctcccgatgacgctgaagagcgccatcgagcttggcctcctggagatcctggtggccgccggcggcaagtcgctgaccccgaccgaggtggccgccaagctcccgtccgcggcgaacccggaagcgccggacatggnggaccgcatactccggctgctcgcgtcgnacaacgtcgtgacgtgcctggtggaggagggcaaggacggccgcctntcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgngtnttcaacgaagggatgaagaaccactccatcatcatcaccaagaagctcctcgagctctaccacggcttcgagggtctcggcagcctcgtcgacgtcggcggnggngtcggcgccaccgtggccgncatagccgcccactaccccaccatnaagggggtcaacttcgacctcccccacgtcatcttcgaggcgccg

SEQ ID NO: 304 - DNA, 788 bp, Lolium perenne
  misc_feature (378)..(378): n is a, c, g, or t
  misc_feature (768)..(768): n is a, c, g, or t
  misc_feature (786)..(786): n is a, c, g, or t
gcaactatagctcgggtctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagagcgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctntcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctnccccacgttatctccgangg

SEQ ID NO: 305 - DNA, 709 bp, Lolium perenne
  misc_feature (8)..(8): n is a, c, g, or t
  misc_feature (25)..(25): n is a, c, g, or t
  misc_feature (30)..(30): n is a, c, g, or t
  misc_feature (584)..(584): n is a, c, g, or t
  misc_feature (589)..(589): n is a, c, g, or t
  misc_feature (595)..(595): n is a, c, g, or t
  misc_feature (598)..(598): n is a, c, g, or t
  misc_feature (646)..(646): n is a, c, g, or t
  misc_feature (649)..(649): n is a, c, g, or t
  misc_feature (674)..(674): n is a, c, g, or t
  misc_feature (676)..(676): n is a, c, g, or t
  misc_feature (696)..(697): n is a, c, g, or t
  misc_feature (701)..(701): n is a, c, g, or t
  misc_feature (705)..(705): n is a, c, g, or t
  misc_feature (709)..(709): n is a, c, g, or t
gtttactnatacctcgggtctctcnttcanccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggtgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcattccgttcaacaaggcctatggcatgtcggtattcgagtaccacggcacggacccgngcttnaaccgngtnttcaacgaagggatgaagaaccactccatcatcatcaccaagaagctnctngagctctaccacggcttccagggtntncggtaccctcgttctacgtnnggcnggtngtgn

SEQ ID NO: 306 - DNA, 1441 bp, Lolium perenne
gggttgcttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcaccttcaagtacccgagcatcaaggggatcaacttcgacctttcccacgtcatcgccgacgccccgccttaccccggcgtggaacacgtcagcggtgaaatggtcaaggagatgccctccggcgacgccatcctcatgaagtggatcctcaactgcttcagcgacgacgagtgcgcctccctgctcaagaactgctacgacgcgctgcccgcccatgccaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagcgtttgcataattgtttttgcaaaaaaaaaa

SEQ ID NO: 307 - DNA, 564 bp, Lolium perenne
  misc_feature (84)..(84): n is a, c, g, or t
  misc_feature (239)..(240): n is a, c, g, or t
  misc_feature (316)..(316): n is a, c, g, or t
  misc_feature (358)..(358): n is a, c, g, or t
  misc_feature (445)..(445): n is a, c, g, or t
  misc_feature (448)..(448): n is a, c, g, or t
  misc_feature (481)..(481): n is a, c, g, or t
  misc_feature (490)..(490): n is a, c, g, or t
  misc_feature (500)..(500): n is a, c, g, or t
  misc_feature (527)..(527): n is a, c, g, or t
  misc_feature (533)..(533): n is a, c, g, or t
  misc_feature (542)..(542): n is a, c, g, or t
  misc_feature (551)..(551): n is a, c, g, or t
  misc_feature (553)..(553): n is a, c, g, or t
  misc_feature (564)..(564): n is a, c, g, or t
ttcttacccagcagcaagcagcaactggtagcatcaatcagacccatcctagcaagcagcaacaggtagcatcagcgacatggncgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgnncaaggccaagcacccggacgcggcgtccatgatagatcgcatgctgcgtgtgctcgcctcgtacaaggtggtgacntgtgaggtggaggagggcaaggacggcagcctctcgcgccgntacggcgccacgccggtgtgccggtggctcgcccccaacgaggacggcgcctccatggccccgttcgctctcctcacccaggaccgngtntttatggaggcgtggtgccacatgaaggacccnatcctgganggcgggaacncgttccacaaggcgttcgggacgtctnggttcnagtacccangccaagacncnccctttaaccn

SEQ ID NO: 308 - DNA, 474 bp, Lolium perenne
  misc_feature (353)..(353): n is a, c, g, or t
  misc_feature (412)..(412): n is a, c, g, or t
  misc_feature (440)..(440): n is a, c, g, or t
  misc_feature (443)..(443): n is a, c, g, or t
  misc_feature (456)..(456): n is a, c, g, or t
  misc_feature (459)..(459): n is a, c, g, or t
  misc_feature (463)..(463): n is a, c, g, or t
  misc_feature (470)..(470): n is a, c, g, or t
  misc_feature (474)..(474): n is a, c, g, or t
gcccagcagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgntacggcgccacgccggtgtgccggtggctcgcccccaacgaggacggcgcctccatggncccgttcgctctcctcacccaggaccgngtnttcatggaggcgnggngccncatgaangacn

SEQ ID NO: 309 - DNA, 589 bp, Lolium perenne
  misc_feature (4)..(6): n is a, c, g, or t
  misc_feature (530)..(530): n is a, c, g, or t
  misc_feature (533)..(533): n is a, c, g, or t
  misc_feature (536)..(536): n is a, c, g, or t
  misc_feature (539)..(539): n is a, c, g, or t
  misc_feature (542)..(542): n is a, c, g, or t
  misc_feature (545)..(545): n is a, c, g, or t
  misc_feature (550)..(550): n is a, c, g, or t
  misc_feature (562)..(562): n is a, c, g, or t
  misc_feature (571)..(571): n is a, c, g, or t
  misc_feature (574)..(574): n is a, c, g, or t
  misc_feature (578)..(578): n is a, c, g, or t
  misc_feature (580)..(580): n is a, c, g, or t
  misc_feature (589)..(589): n is a, c, g, or t
ggtnnnttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgctccacagggcgttcgggacgtcgnggntcnagnacncangccangacgcgcgcttnaaccgactnttnaacnangccatggan

SEQ ID NO: 310 - DNA, 644 bp, Lolium perenne
  misc_feature (8)..(8): n is a, c, g, or t
  misc_feature (453)..(453): n is a, c, g, or t
  misc_feature (468)..(468): n is a, c, g, or t
  misc_feature (496)..(497): n is a, c, g, or t
  misc_feature (511)..(511): n is a, c, g, or t
  misc_feature (517)..(517): n is a, c, g, or t
  misc_feature (531)..(531): n is a, c, g, or t
  misc_feature (586)..(586): n is a, c, g, or t
  misc_feature (593)..(593): n is a, c, g, or t
  misc_feature (610)..(610): n is a, c, g, or t
  misc_feature (619)..(619): n is a, c, g, or t
  misc_feature (638)..(638): n is a, c, g, or t
  misc_feature (643)..(644): n is a, c, g, or t
ggagatanctcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcnatcctggagggcggnagtgcgctccacagggcgttcgggacgnngtggttcgagtacncaggcnaggacccgcgcttnaaccgactcttcaacgaggccatggagcaccactcggtcatactcaccaagaagnttctccngctgtacaagggcttcnacggcatcngccccctggttgatgtggnaggcnn

SEQ ID NO: 311 - DNA, 688 bp, Lolium perenne
  misc_feature (2)..(2): n is a, c, g, or t
  misc_feature (5)..(6): n is a, c, g, or t
  misc_feature (14)..(14): n is a, c, g, or t
  misc_feature (523)..(523): n is a, c, g, or t
  misc_feature (600)..(600): n is a, c, g, or t
  misc_feature (604)..(604): n is a, c, g, or t
  misc_feature (688)..(688): n is a, c, g, or t
gnttnnttacccancagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtcgctcgcccccaacgaggacggcgcctccatggccccgttcgctctcctcacccaggaccgcgtcttcatggaggcgtggtgccacatgaaggacgcgatcctggagggcggcagcgcgttccacagggcgttcggnacgtcgtggttcgagtacgcaggccaggacgcgcgcttcaaccgactcttcaacgaggccatggagcaccactcggncatnctcaccaagaagctcctcgagctgtacaagggcttcgacggcatcggcaccctggttgatgtggcaggcggcgtgggcgccgtn

SEQ ID NO: 312 - DNA, 677 bp, Lolium perenne
  misc_feature (613)..(614): n is a, c, g, or t
  misc_feature (631)..(632): n is a, c, g, or t
  misc_feature (643)..(643): n is a, c, g, or t
  misc_feature (650)..(651): n is a, c, g, or t
  misc_feature (657)..(657): n is a, c, g, or t
  misc_feature (660)..(660): n is a, c, g, or t
  misc_feature (662)..(662): n is a, c, g, or t
  misc_feature (667)..(669): n is a, c, g, or t
  misc_feature (672)..(672): n is a, c, g, or t
  misc_feature (674)..(674): n is a, c, g, or t
  misc_feature (677)..(677): n is a, c, g, or t
gccagcagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggcgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctnnagctgtacaagggcttnnacggcatcggnaccctgnntgatgnggnangcggnnnggncnccn

SEQ ID NO: 313 - DNA, 790 bp, Lolium perenne
  misc_feature (752)..(752): n is a, c, g, or t
  misc_feature (758)..(758): n is a, c, g, or t
accagcagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtggcgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgttatcgccgacnccccgncttaccccggcgtggagcacgtcagcggtgaa

SEQ ID NO: 314 - DNA, 766 bp, Lolium perenne
  misc_feature (2)..(2): n is a, c, g, or t
  misc_feature (6)..(7): n is a, c, g, or t
gngttnnttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgacctttcccacgtcatcgccgacgcccc

SEQ ID NO: 315 - DNA, 795 bp, Lolium perenne
  misc_feature (2)..(2): n is a, c, g, or t
  misc_feature (5)..(7): n is a, c, g, or t
  misc_feature (15)..(15): n is a, c, g, or t
  misc_feature (757)..(757): n is a, c, g, or t
gngtnnnttacccancagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgctcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgacctttcccacgtcatcgncgacgccccgccttaccccggcgtggagcacgtcagcg

SEQ ID NO: 316 - DNA, 805 bp, Lolium perenne
  misc_feature (2)..(2): n is a, c, g, or t
  misc_feature (6)..(7): n is a, c, g, or t
gngttnnttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtcgctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgacctttcccacgtcatcgccgacgccccgccttaccccggcgtggagcacgtcagcggtgacatgtt

SEQ ID NO: 317 - DNA, 810 bp, Lolium perenne
  misc_feature (571)..(571): n is a, c, g, or t
  misc_feature (687)..(687): n is a, c, g, or t
  misc_feature (689)..(689): n is a, c, g, or t
  misc_feature (695)..(695): n is a, c, g, or t
  misc_feature (735)..(735): n is a, c, g, or t
  misc_feature (808)..(808): n is a, c, g, or t
ggttctttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactnttcaacgaggccatggagcaccactcggtcatcctcaccaagaagctcctcgagctgtacaagggcttcgacggcatcggcaccctggttgatgtggcaggcggcgtgggcgcccntntccacnccatcacctccaagtacccgagcatcaagggatcaacttngaccttccccacgttattcgccgacgccccgattaccccggcgtggaacacgtcagcggtgacattgttcaanaa

SEQ ID NO: 318 - DNA, 778 bp, Lolium perenne
  misc_feature (336)..(336): n is a, c, g, or t
  misc_feature (546)..(546): n is a, c, g, or t
  misc_feature (624)..(624): n is a, c, g, or t
  misc_feature (633)..(633): n is a, c, g, or t
  misc_feature (675)..(675): n is a, c, g, or t
  misc_feature (717)..(717): n is a, c, g, or t
  misc_feature (727)..(727): n is a, c, g, or t
  misc_feature (735)..(735): n is a, c, g, or t
  misc_feature (740)..(740): n is a, c, g, or t
  misc_feature (763)..(763): n is a, c, g, or t
  misc_feature (768)..(768): n is a, c, g, or t
  misc_feature (772)..(773): n is a, c, g, or t
gcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctntcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttnaaccgactcttcaacgaggccatggagcaccactcggtcatcctcaccaagaagctccttgagctgtacaagggcttngacggcatnggcaccctggttgatgtggcaggcggcgtgggcgccctcatncacgccatcaccttcaagtacccgagcattaaggggatcaanttcgaccttnccaacgtnatttncgacgccccgccttaccccggcntgganaacnntagcg

SEQ ID NO: 319 - DNA, 774 bp, Lolium perenne
  misc_feature (3)..(3): n is a, c, g, or t
gtntcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccaaatgaaggacggatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgctatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgccaccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggaga

SEQ ID NO: 320 - DNA, 779 bp, Lolium perenne
  misc_feature (717)..(717): n is a, c, g, or t
  misc_feature (729)..(729): n is a, c, g, or t
  misc_feature (732)..(732): n is a, c, g, or t
  misc_feature (750)..(750): n is a, c, g, or t
cttaccagcagcaagcagcaactggtagcatcaatcagacccatcctagcaaggagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtattcacgccatcaccttcaagtacccgagcatcaangggatcaacttnganctttcccacgttatcgcngacgccccgccttaccccggggtggagca

SEQ ID NO: 321 - DNA, 775 bp, Lolium perenne
  misc_feature (23)..(23): n is a, c, g, or t
  misc_feature (350)..(350): n is a, c, g, or t
  misc_feature (420)..(420): n is a, c, g, or t
  misc_feature (602)..(602): n is a, c, g, or t
  misc_feature (688)..(688): n is a, c, g, or t
  misc_feature (724)..(724): n is a, c, g, or t
  misc_feature (741)..(741): n is a, c, g, or t
tagcagcaaccagcaactggtancatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgntacggcgccacgccggtgtgccggtggctcgcccccaacgaggacggcgcctccatggccccgttcgctntcctcacccaggaccgcgtcttcatggaggcgtggcgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaanaagctcctcgagctgtacaagggcttcgacggcatcggcaccctggttgatgtggcaggcggcgtgggcgccgtattcacgccatnaccttcaagtacccgagcatcaaggggatcaacttngaccttcccacgttatngccgacgcccccccttaccccggcgtggagcacg

SEQ ID NO: 322 - DNA, 789 bp, Lolium perenne
  misc_feature (5)..(5): n is a, c, g, or t
  misc_feature (451)..(451): n is a, c, g, or t
  misc_feature (691)..(691): n is a, c, g, or t
  misc_feature (736)..(736): n is a, c, g, or t
  misc_feature (751)..(751): n is a, c, g, or t
  misc_feature (778)..(778): n is a, c, g, or t
ggttntttacccagcagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtnttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggccatcctcaccaagaagctcctcgagctgtacaagggcttcgacggcatcggcaccctggttgatgtggcaggcggcgtgggcgccgtcatncacgccatcaccttcaagtacccgagcattaaggggatcaacttngacctttcccacgtnatcgccgacgccccgccttaccccggngtggagcacgt

SEQ ID NO: 323 - DNA, 750 bp, Lolium perenne
  misc_feature (2)..(2): n is a, c, g, or t
  misc_feature (14)..(14): n is a, c, g, or t
  misc_feature (361)..(361): n is a, c, g, or t
  misc_feature (431)..(431): n is a, c, g, or t
  misc_feature (451)..(451): n is a, c, g, or t
  misc_feature (690)..(690): n is a, c, g, or t
  misc_feature (720)..(720): n is a, c, g, or t
  misc_feature (735)..(735): n is a, c, g, or t
  misc_feature (750)..(750): n is a, c, g, or t
gnttgcttacccancagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgntacggcgccacgccggtgtgccggtggctcgcccccaacgaggacggcgcctccatggccccgttcgctntcctcacccaggaccgcgtnttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggccatcctcaccaagaagctcctcgagctgtacaagggcttcgacggcatcggcaccctggttgatgtggcaggcggcgtgggccccgtatncacgccatcaccttcaagtacccgagcatnaaggggatcaacttngacctttcccacgtn

SEQ ID NO: 324 - DNA, 804 bp, Lolium perenne
  misc_feature (4)..(6): n is a, c, g, or t
  misc_feature (87)..(87): n is a, c, g, or t
  misc_feature (242)..(242): n is a, c, g, or t
  misc_feature (750)..(750): n is a, c, g, or t
  misc_feature (804)..(804): n is a, c, g, or t
ggtnnnttacccagcagcaagcagcaactggtagcatcaatcagacccatcctaccaagcagcaacaggtagcatcagcgacatggncgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgnccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggccatcctcaccaagaagctcctcgagctgtacaagggcttcgacggcatcggcaccctggttgatgtggcaggcggcgtgggcgccgtcatcacgccatcaccttcaagtacccgagcatcaaggggatcaacttcgacctttcccacgtnatcgccgacgccccgccttaccccggcgtggagcacgtcagcggtgacatgttn

SEQ ID NO: 325 - DNA, 794 bp, Lolium perenne
  misc_feature (4)..(4): n is a, c, g, or t
  misc_feature (12)..(12): n is a, c, g, or t
  misc_feature (429)..(429): n is a, c, g, or t
  misc_feature (674)..(674): n is a, c, g, or t
  misc_feature (745)..(745): n is a, c, g, or t
  misc_feature (752)..(752): n is a, c, g, or t
  misc_feature (764)..(764): n is a, c, g, or t
  misc_feature (788)..(788): n is a, c, g, or t
  misc_feature (790)..(790): n is a, c, g, or t
  misc_feature (794)..(794): n is a, c, g, or t
ttgnttacccancagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctntcctcacccaggaccgcgtcttcatggaggcgtggtaccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccttggttgatgtggcaggcggngtgggcgccgtcatccacgccatcaccttcaagtacccgagcatcaaggggatcaactttgacctttcccnggtattngccgacgccccnccttaccccggggtggagcacgtnancggn

SEQ ID NO: 326 - DNA, 808 bp, Lolium perenne
  misc_feature (2)..(2): n is a, c, g, or t
  misc_feature (5)..(7): n is a, c, g, or t
  misc_feature (752)..(752): n is a, c, g, or t
  misc_feature (768)..(768): n is a, c, g, or t
gngtnnnttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcaccttcaagtacccgagcatcaaggggatcaacttcgacctttcccacgtnatcgccgacgccccgncttaccccggcgtggagcacgtcagcggtgacatgttcaa

SEQ ID NO: 327 - DNA, 799 bp, Lolium perenne
  misc_feature (748)..(748): n is a, c, g, or t
tgcttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtcgctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcaccttcaagtacccgagcatcaaggggatcaacttcgacctttcccacgtnatcggcgacgccccgccttaccccggggtggagcacgtcagcggtgacatg

SEQ ID NO: 328 - DNA, 774 bp, Lolium perenne
  misc_feature (71)..(71): n is a, c, g, or t
  misc_feature (435)..(435): n is a, c, g, or t
  misc_feature (720)..(720): n is a, c, g, or t
  misc_feature (735)..(735): n is a, c, g, or t
  misc_feature (751)..(751): n is a, c, g, or t
  misc_feature (774)..(774): n is a, c, g, or t
gcaagcagcaactggtagcatcaatcagacccatcctaccaagcagcaacaggtagcatcagcgacatggncgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtnttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggccatcctcaccaagaagctcctcgagctgtacaagggcttcgacggcatcggcaccctggttgatgtggcaggcggcgtgggcgccgtcatccacgccatcaccttcaagtacccgagcatcaaggggatcaacttngacctttcccacgtnatcgccgacgccccgncttaccccggcgtggagcacgtn

SEQ ID NO: 329 - DNA, 807 bp, Lolium perenne
  misc_feature (22)..(22): n is a, c, g, or t
  misc_feature (440)..(440): n is a, c, g, or t
  misc_feature (710)..(710): n is a, c, g, or t
  misc_feature (725)..(725): n is a, c, g, or t
  misc_feature (779)..(779): n is a, c, g, or t
  misc_feature (800)..(800): n is a, c, g, or t
cagcagcacgcagcaactggtngcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtnttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcaccttcaagtacccgagcatnaaggggatcaacttngacctttcccacgttatcgccgacgccccgccttaccccggcgtggagcacgtnagcggtgacatgttcaagaanatgcccc

SEQ ID NO: 330 - DNA, 775 bp, Lolium perenne
  misc_feature (703)..(703): n is a, c, g, or t
  misc_feature (754)..(754): n is a, c, g, or t
gttcttacccaccagcaagcagcaactggtagcatcaatcagacccatcctaccaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtggcgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctncaagtacccgagcatcaaggggatcaacttcgaccttccccacgttatcgncgacgccccgccttaccccgg

SEQ ID NO: 331 - DNA, 763 bp, Lolium perenne
  misc_feature (13)..(13): n is a, c, g, or t
  misc_feature (747)..(747): n is a, c, g, or t
gttttgccgtaanccacgccatcaccttcaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgccaccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagagtttgcataattgnttttgcaaaaaaaaaa

SEQ ID NO: 332 - DNA, 805 bp, Lolium perenne
  misc_feature (30)..(30): n is a, c, g, or t
  misc_feature (724)..(724): n is a, c, g, or t
  misc_feature (782)..(782): n is a, c, g, or t
  misc_feature (793)..(793): n is a, c, g, or t
gctgtcgtggttcgagtacgcaggccaggncgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgcctccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaagtactactcgacaaagatcatgttatcgngttatattttctgctgcttgctatatttccttcagttattatgtattctactcttcanaaataaatggncacgcagcgtga

SEQ ID NO: 333 - DNA, 777 bp, Lolium perenne
ggttcagtcgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgcctccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaagtactactcgacaaagatcatgttatcgggttatattttctgctgcttgctatatttccttcaggtattatggattctactcttcaaaataa

SEQ ID NO: 334 - DNA, 771 bp, Lolium perenne
  misc_feature (30)..(30): n is a, c, g, or t
  misc_feature (760)..(760): n is a, c, g, or t
gctgtcgtggttcgagtacgcaggccaggncgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgcctccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaagtactactcgacaaagatcatgttatcgggttatattttctgctgcttgctatatttccttcagntattatgtatt

SEQ ID NO: 335 - DNA, 450 bp, Lolium perenne
  misc_feature (82)..(82): n is a, c, g, or t
  misc_feature (434)..(434): n is a, c, g, or t
cgtcgatttgagcctgcttgtgtacagcccgggcggcaaggagaggtaccacagggacctggagaagctcgccaagggcggnggctttaccagcgtcacggccacctacatcttcgccgacttctgggccatggagtacactaagtagtagtatccatgttccaaattataagacattttggtaggctaaactcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagcgtttgcataattgnttttgcaaaaaaaaaa

SEQ ID NO: 336 - DNA, 305 bp, Lolium perenne
tagtagtatccatgttccaaattataagacattttggtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagagtttgcataattgtttttgcaaaaaaaaaa

SEQ ID NO: 337 - DNA, 576 bp, Lolium perenne
  misc_feature (4)..(4): n is a, c, g, or t
  misc_feature (13)..(13): n is a, c, g, or t
gacnacgagtgcnccccctgctcaagactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagcgtttgcataattgtttttgtaaaaaaaaaa

SEQ ID NO: 338 - DNA, 576 bp, Lolium perenne
  misc_feature (3)..(3): n is a, c, g, or t
  misc_feature (12)..(12): n is a, c, g, or t
  misc_feature (87)..(87): n is a, c, g, or t
  misc_feature (382)..(382): n is a, c, g, or t
  misc_feature (440)..(440): n is a, c, g, or t
acnacgagtgcnccccctgctcaagaactgctacgacgcgctgcccgcccatggcaaagtcatcaacgtcgagtgcatcttgccggngaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaactcacctaccaaaatatcttatatctacgaacgtaggtactactcgacaaagatcatgttatcgngttatattttctgctgcttgctatatttccttcagttattatgtattctactcttcanaaataaatggccacgcagcgtgagtctgttcacgacgtgagctcaagatgtcaactcagtcattgcatagtcattgcatggatcttttactaagccctaataaagcgtttgcataattgtttttgtaaaaaaaaaa

SEQ ID NO: 339 - DNA, 330 bp, Lolium perenne
  misc_feature (79)..(79): n is a, c, g, or t
  misc_feature (323)..(323): n is a, c, g, or t
  misc_feature (330)..(330): n is a, c, g, or t
ccggctttccagcgtcacggcccctacatcttcgccgacttctgggccatggagtacactaagtagtagtatccatgtngcaaattataagacattttggtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttaanaaaaaan

SEQ ID NO: 340 - DNA, 730 bp, Lolium perenne
  misc_feature (648)..(648): n is a, c, g, or t
  misc_feature (651)..(651): n is a, c, g, or t
  misc_feature (693)..(693): n is a, c, g, or t
aagcagctcgatcggctgcacagctccgaagagggcaaactcatgggctccactggcgccgaaatggtcgtcatcccggcagcaaacaacgacgaagactcatgcacgtacgcgatgcagctggcggcagcgtgtatcttgccgatgacgcctcaaaacgccatcgagctaggcatgctggagatcctggtgggcgccggcgggaaggctctgtcgccgtccgaggtggccgcgcggctgccatcgaccactaccaacccggacgcgccggcaatggtggaccgcatgctgcggctgctggcgtcgttcaacgtggtgtcgtgcgaggtggaggagggtaaggacggccttctcgcccgccggtacggccccgcgccggtatgtaagtggctcacacccaacgaggacggcgtctccatggccgcgctgctcctcatgtgccacgataaggtcactatgaagagctggtatcatttgaaggacgcagtcctcaacggcggcctcccgttcgagaaggcgcacgggatgccggcgttcaagtaccacggcacggacccgcggttcaatcgcgtgtttaacgagggcatgaagaaccactccaccatcatcaccaagaagctcctcgagtcctacacgggcttcgacggnctncgcgccctcgtcgacatcggcggcggtaccggtgccaccatncacgccattacctcgaagtatccacaactcagcggag

SEQ ID NO: 341 - DNA, 1536 bp, Lolium perenne
gaattcgattaagcagtggtaacaacgcagagtacgcgggggtgcttacccagcagcaagcagcaactggtagcatcaatcagacccatcctagcaagcagcaacaggtagcatcagcgacatggccgacgaagaggcgtgcatgttcgctctgcagctggccaactcggctgtgctgccgatggcgattaggacatccatcgagctgggccttctggagactcttgtgggcgccggcgggaagttgctgactcccgaagaggctgtcaagaagctgccgtccaaggccaagcacccggacgcggcgtccatgatagatcgcatgctgcgtgtgctcgcctcgtacaaggtggtgacgtgtgaggtggaggagggcaaggacggcagcctctcgcgccgctacggcgccacgccggtgtgccggtggctcgcccccaacgaggacggcgcctccatggccccgttcgctctcctcacccaggaccgcgtcttcatggaggcgtggtgccacatgaaggacgcgatcctggagggcggcagcgcgttccacagggcgttcgggacgtcgtggttcgagtacgcaggccaggacgcgcgcttcaaccgactcttcaacgaggccatggagcaccactcggtcatcctcaccaagaagctcctcgagctgtacaagggcttcgacggcatcggcaccctggttgatgtggcaggcggcgtgggcgccgtcatccacgccatcacctccaagtacccgagcatcaaggggatcaacttcgaccttccccacgtcatcgccgacgccccgccttaccccggcgtggagcacgtcagcggtgacatgttcaagaagatgccctccggcgacgccatcctcatgaagtggatcctcaactgcttcagcgacgacgagtgcgccaccctgctcaagaactgctacgacgcgctgcccgcccatggcaaagtcatcaacgtcgagtgcatcttgccggtgaatccggacgccaccaacggtgcgcaggcgttgatcgccgtcgatttgagcctgcttgtgtacagcccgggcggcaaggagaggtaccacagggacctggagaagctcgccaagggcgccggctttaccagcgtcacggccacctacatcttcgccgacttctgggccatggagtacactaagtagtagtatccatgttccaaattataagacattttggtaggctaaagtcacctaccaaaatatcttatatctacgaacgtaggtactactcgacaaagatcatgttatcgtgttatattttctgctgcttgctatatttccttcagttattatgtattctactcttcagaaataaatggccacgcagcgtgagtctgttcacgacgtgagctcaagatgtcaactcagtcattgcatagtcattgcatggatcttttactaagccctaataaagagtttgcataattgtttttgcaaagaaaaaaaaaaaaaaaaaaaaaagtactctgcgttgttaccactgcttaatcactagtgaattc

SEQ ID NO: 342 - DNA, 1581 bp, Lolium perenne
gaattcactagtgattaagcagtggtaacaacgcagagtacgcggggacaactcatagctcgggtctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggtgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctatggcatgtcggcattcgagtaccacggcacggacccgcgcttcaaccgcgtcttcaacgaagggatgaagaaccactccatcatcatcaccaagaagctcctcgagctctaccacggcttccagggtctcggcaccctcgtcgacgtcggcggcggcgtcggcgccaccgtggccgccatagccgcccactaccccgccatcaagggggtcaacttcgacctcccccacgtcatctccgaggcgccgcagttcccgggcgtcacccacgtcggtggcgacatgttcaaggaggtgccctcgggagatgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccgggggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatctgaatacgtaccctgcttggttttttctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttgttgaatatacgagtaaattgaagccaaaaaaaaaaaaaaaaaaaaaaaaaaaaagtactctgcgttgttaccactgcttaatcgaattc

SEQ ID NO: 343 - DNA, 753 bp, Lolium perenne
  misc_feature (5)..(5): n is a, c, g, or t
  misc_feature (11)..(11): n is a, c, g, or t
  misc_feature (13)..(13): n is a, c, g, or t
  misc_feature (24)..(24): n is a, c, g, or t
  misc_feature (752)..(753): n is a, c, g, or t
cagantgttcntngctggcacagnacacgtcatacgtcgtcctggagttcgccatggccgagctcatgcggaagccacacctcatggccaagctccaagccgaggttaggaacaacacgcccaaggaccagcagatggtcacggaggacgatttgggccgcatgccctacctaaaagctgtcttaaaggagactgtccggctgcatccgccgttgcccctcttgctcccgcacctcaccgtggagaagtgcgtcctcgacggcctcacgatccccgccgaaacccgcgtcatcatcaacgtctgggscmtcggtagagatgccggatcgtggaaggaggcggacaggttcatgcctgagcggttcgaggatgccgcggccccggacttcaaggggagggattttcagctcctgccgttcggaggtgggcgacggatgtgtcccgggataaacttcgggatgtccacggtggagatcatgctcgccaaccttgtctactgcttcaactgggagcccccttttggaatgaggcatgaggacatcgatatgactgatgtgttcgggatgacagttcgtagaaagcaaaagctacttcttgtcccaagatcaccacgacttgttaattagtcgttcataatatttgtcataaattttggggcacttgaattgtaatggttgatccgacccaatatactacatacattwcvgaattataagatgttttkcggacatattttmawttssagtttwaann

SEQ ID NO: 344 - DNA, 358 bp, Lolium perenne
  misc_feature (5)..(5): n is a, c, g, or t
  misc_feature (352)..(353): n is a, c, g, or t
ggttntgcctgagcggttcgaggatgccgcggccccggacttcaaggggagggattttcagctcctgccgttcggaggtgggcgacggatgtgtcccgggataaacttcgggatgtccacggtggagatcatgctcgccaaccttgtctactgcttcaactgggagcccccttttggaatgaggcatgaggacatcgatatgactgatgtgttcgggatgacagttcgtagaaagcaaaagctacttcttgtcccaagatcaccacgacttgttaattagtcgttcataatatttgtcataaattttgtgcacttgaattgtaatggttgatccgaccaatatactactaannaaaaa

SEQ ID NO: 345 - DNA, 431 bp, Lolium perenne
  misc_feature (19)..(20): n is a, c, g, or t
  misc_feature (415)..(415): n is a, c, g, or t
ggctcggtagagagccggnncgtggaggaggcggacaggttcatgcctgagcggttcgaggatgccgcggccccggacttcaaggggagggattttcagctcctgccgttcggaggtgggcgacggatgtgtcccaggataaacttcgggatgtccacggtggagatcatgctcgccaaccttgtctactgcttcaactgggagcccccttttggaatgaggcatgaggacatcgatatgactgatgtgttcgggatgacagttcgtagaaagcaaaagctacttcttgtcccaagatcaccacgacttgttaattagtcgttcataatatttgtcataaattttggggcacttgaattgtaatggttgatccgaccaatatactacatacatttccgaattataagatgttttnggacatattttcaatt

SEQ ID NO: 346 - DNA, 743 bp, Lolium perenne
  misc_feature (5)..(5): n is a, c, g, or t
  misc_feature (11)..(11): n is a, c, g, or t
  misc_feature (13)..(13): n is a, c, g, or t
  misc_feature (24)..(24): n is a, c, g, or t
  misc_feature (446)..(446): n is a, c, g, or t
  misc_feature (575)..(575): n is a, c, g, or t
  misc_feature (590)..(590): n is a, c, g, or t
  misc_feature (643)..(643): n is a, c, g, or t
  misc_feature (677)..(677): n is a, c, g, or t
  misc_feature (701)..(701): n is a, c, g, or t
  misc_feature (712)..(713): n is a, c, g, or t
  misc_feature (720)..(720): n is a, c, g, or t
  misc_feature (743)..(743): n is a, c, g, or t
cagantgttcntngctggcacagnacacgtcatacgtcgtcctggagttcgccatggccgagctcatgcggaagccacacctcatggccaagctccaagccgaggttaggaacaacacgcccaaggaccagcagatggtcacggaggacgatttgggccgcatgccctacctaaaagctgtcttaaaggagactgtccggctgcatccgccgttgcccctcttgctcccgcacctcaccgtggagaagtgcgtcctcgacggcctcacgatccccgccgaaacccgcgtcatcatcaacgtctgggccatcggtagagatgccggatcgtggaaggaggcggacaggttcatgcctgagcggttcgaggatgccgcggccccggacttcaaggggagggattttcagctcctgccgttcggaggtgggcgacggatgtgtcccggnataaacttcgggatttccacggtggagatcatgctcgccaaccttgtctactgcttcaactgggagcccccttttggaatgaggcatgaggacatcgatatgactgatgtgttcgggatgacagttcgnaaaaagcaaaagctncttcttgtcccaagatcaccacgacttgttaattagtcgttcataatattcgncataaatttgggcacttgaattgtaatggttganccgaacaatatactacataccttncggaattatannatgtttngcacatatttaattggagttttn

SEQ ID NO: 347 - DNA, 1503 bp, Lolium perenne
  misc_feature (2)..(2): n is a, c, g, or t
gngtcggctccggctcgcgtccatggtgctcttcgaggccaacatccttagcctccttgccgaggttctctcggccgtgttctgcgaggtcatgaatggcaagccggagtttaccgaccacctcacacacaagctgaagcatcatcccggacagatcgaggccgcagccatcatggagcacatccttgaaggaagttyctayatgawgctcgccaagaagctcggcgagcttgacccactgatgaagccaaagcaagataggtatgccctccgaacatcgccacaatggcttggccctcagattgaggttatccgtgccgccaccaagtccatcgagcgcgagatcaactccgtcaatgacaacccactcattgatgtctcccgaggcaaggccatccacggtggcaacttccagggcactcccatcggcgtgtccatggacaacaccaggcttgccattgctgcgatcggcaagctcatgtttgcccagttctccgagctagtgaacgacttctacaacaatggtttgccttccaatctctgcggtgggcgcaacccgagcttggactatggcttgaagggtgctgagattgccatggcctcctactgctccgagctccaattcttgggcaaccccgtgactaaccatgtgcagagtgcggagcagcacaaccaagacgtcaactctctcggtctcatctcttccaggaagaccgctgaggccatcgacattttgaagctcatgtcctcgacattcttggtcgccctgtgccaggctatcgacctccgccacctcgaggagaatgtcaggggtgccgtcaagaactgtgtgaagatggtggcaaggaagaccctgagcaccaatgacaatggccatctccacaacgcacgcttctgcgagaaggacctgctcctgacgatcgaccgyraggccgtgttcgcctacgcagaygacccttgcagcgchaactacccactgatgcagaagatgcgtgcagttctcgtggagcacgccttggccaacggtgaggctgagcgggatgtgcagacgtcagtgttcgccaagctcgccgcattcgagcaggagctccgtgcggtgcttccaagggaggtcgagtcagcccggtgygccgtggagaatggcaccgccgcgcagcaaaaccgcatcaccgaatgccggtcatacccgctgtatcgcttcgtgcgcaaggagctsggaaccgagtacttgaccggagagaagacgaggtctcctggtgaagaggtggacaaggtgtttgtggccatgaacaaggggraacacatcgacgcgctgcttgagtgcctcaaggagtggaatggtgagcccctgcctatctgctgaagaatgaatcaaggaactgaagaawaaaadacttsagartycagaaggytycacatgtgcttagttaatwagtayagtactgttttttcattgtatcttctgatgttgtcgtctgcgacgtccttctagacctgccgtac

SEQ ID NO: 348 - DNA, 791 bp, Lolium perenne
  misc_feature (2)..(2): n is a, c, g, or t
  misc_feature (787)..(787): n is a, c, g, or t
gngtcggctccggctcgcgtccatggtgctcttcgaggccaacatccttagcctccttgccgaggttctctcggccgtgttctgcgaggtcatgaatggcaagccggagtttaccgaccacctcacacacaagctgaagcatcatcccggacagatcgaggccgcagccatcatggagcacatccttgaaggaagttcctatatgaagcttgcaaagaagctcggcgagctcgacccgctcatgaagccgaagcaagataggtatgctctccggacatcgcctcagtggttgggccctcagattgaggttatccgtgccgccaccaagtcgattgagcgcgagatcaactccgtcaacgacaacccactcatcgacgtctcccggggcaaggctatccatggcggcaacttccagggcaccccaatcggcgtgtccatggacaacacgaggcttgccattgctgcgatcggcaagctcatgtttgcccagttctcggagctggttaacgacttctacaacaacggtttgccttccaatctctctggtgggcgcaacccgagtttggactatggcttcaagggtgctgagattgccatggcctcctactgctccgagcttcaattcttgggcaaccccgtgactaaccatgtccagagcgcagagcagcacaaccaagacgtcaattctctaggtctcatctcttcaaggaagaccgccgaggccatcgatattttgaagctcatgtcatcgacattcttggtcgcgttgtgccaagctatcgacctncggc

SEQ ID NO: 349 - DNA, 748 bp, Lolium perenne
  misc_feature (11)..(11): n is a, c, g, or t
ttctacatgangctcgccaagaagctcggcgagcttgacccactgatgaagccaaagcaagataggtatgccctccgaacatcgccacaatggcttggccctcagattgaggttatccgtgccgccaccaagtccatcgagcgcgagatcaactccgtcaatgacaacccactcattgatgtctcccgaggcaaggccatccacggtggcaacttccagggcactcccatcggcgtgtccatggacaacaccaggcttgccattgctgcgatcggcaagctcatgtttgcccagttctccgagctagtgaacgacttctacaacaatggtttgccttccaatctctgcggtgggcgcaacccgagcttggactatggcttgaagggtgctgagattgccatggcctcctactgctccgagctccaattcttgggcaaccccgtgactaaccatgtgcagagtgcggagcagcacaaccaagacgtcaactctctcggtctcatctcttccaggaagactgctgaggccatcgacattttgaagctcatgtcctcgacattcttggtcgccctgtgccaggctatcgacctccgccacctcgaggagaatgtcaggggtgccgtcaagaactgtgtgaagatggtggcaaggaagaccctgagcaccaatgacaatggccatctccacaacgcacgcttctgcgagaaggacctgctcctgacgatcgaccgcaaggccgtgttcgcct

SEQ ID NO: 350 - DNA, 753 bp, Lolium perenne
tgatgctcgccaagaagctcggcgagcttgacccactgatgaagccaaagcaagataggtatgccctccgaacatcgccacaatggcttggccctcagattgaggttatccgtgccgccaccaagtccatcgagcgcgagatcaactccgtcaatgacaacccactcattgatgtctcccgaggcaaggccatccacggtggcaacttccagggcactcccatcggcgtgtccatggacaacaccaggcttgccattgctgcgatcggcaagctcatgtttgcccagttctccgagctagtgaacgacttctacaacaatggtttgccttccaatctctgcggtgggcgcaacccgagcttggactatggcttgaagggtgctgagattgccatggcctcctactgctccgagctccaattcttgggcaaccccgtgactaaccatgtgcagagtgcggagcagcacaaccaagacgtcaactctctcggtctcatctcttccaggaagactgctgaggccatcgacattttgaagctcatgtcctcgacattcttggtcgccctgtgccaggctatcgacctccgccacctcgaggagaatgtcaggggtgccgtcaagaactgtgtgaagatggtggcaaggaagaccctgagcaccaatgacaatggccatctccacaacgcacgcttctgcgagaaggacctgctcctgacgatcgaccgcaaggccgtgttcgcctacgcagatgacc

SEQ ID NO: 351 - DNA, 759 bp, Lolium perenne
  misc_feature (21)..(21): n is a, c, g, or t
  misc_feature (29)..(29): n is a, c, g, or t
gggcaaccccgtgcctaaccntgtgcagngtgcggagcagcacaaccaagatgtcaactctctcggtctcatctcttccaggaagaccgctgaggccatcgacattttgaagctcatgtcctcgacattcttggtcgcgctgtgccaggctatcgacctccgccacctcgaggagaacgtcaggggtgccgtcaagaactgtgtgaagatggtggcaaggaagaccctgagcaccaatgacaatggccatctccacaacgcacgcttctgcgagaaggacctgctcctgacgatcgaccgtgaggccgtgttcgcctacgcagatgacccttgcagcgcaaactacccactgatgcagaagatgcgtgcagttctcgtggagcatgccttggccaacggtgaggctgagcgggatgtgcagacgtcagtgttcgccaagctcgccgcattcgagcaggagctccgtgcggtgcttccaagggaggtcgagtcagcccggtgcgccgtggagaatggcaccacagcgcagcataaccgcatcaccgaatgccggtcatacccgctctatcgcttcgtgcgcaaggagctgggaaccgagtacttgaccggagagaagacgaggtctcctggtgaggaggtggacaaggtgtttgttgccatgaacaagggtaagcacatcgacgcgctgcttgagtgcctcaaggagtggaatggtgagcccctgcccatctgctgaagaatgaatcaaggaactgaaga

SEQ ID NO: 352 - DNA, 766 bp, Lolium perenne
  misc_feature (19)..(19): n is a, c, g, or t
  misc_feature (82)..(82): n is a, c, g, or t
  misc_feature (242)..(242): n is a, c, g, or t
  misc_feature (356)..(356): n is a, c, g, or t
  misc_feature (407)..(407): n is a, c, g, or t
  misc_feature (424)..(424): n is a, c, g, or t
  misc_feature (469)..(469): n is a, c, g, or t
  misc_feature (478)..(478): n is a, c, g, or t
  misc_feature (491)..(491): n is a, c, g, or t
  misc_feature (498)..(498): n is a, c, g, or t
  misc_feature (524)..(524): n is a, c, g, or t
  misc_feature (541)..(541): n is a, c, g, or t
  misc_feature (569)..(569): n is a, c, g, or t
  misc_feature (572)..(572): n is a, c, g, or t
  misc_feature (590)..(590): n is a, c, g, or t
  misc_feature (611)..(611): n is a, c, g, or t
  misc_feature (614)..(614): n is a, c, g, or t
  misc_feature (629)..(629): n is a, c, g, or t
  misc_feature (659)..(659): n is a, c, g, or t
  misc_feature (664)..(664): n is a, c, g, or t
  misc_feature (667)..(667): n is a, c, g, or t
  misc_feature (680)..(680): n is a, c, g, or t
  misc_feature (689)..(689): n is a, c, g, or t
  misc_feature (708)..(708): n is a, c, g, or t
  misc_feature (714)..(714): n is a, c, g, or t
  misc_feature (720)..(720): n is a, c, g, or t
  misc_feature (735)..(735): n is a, c, g, or t
  misc_feature (737)..(737): n is a, c, g, or t
  misc_feature (743)..(743): n is a, c, g, or t
  misc_feature (748)..(748): n is a, c, g, or t
  misc_feature (757)..(757): n is a, c, g, or t
gcaaccctgtgactaaccntgttcagagcgccgagcagcacaaccaagacgtcaactctctcggcctcatctcttccaggangaccgctgaggcgattgacattttgaagctcatgtcctcgacattcatggtcgccttgtgccaagctatcgacctccgccacatcgaggagaatgtcaagaatgccgtcaagaactgtgtgaagacggtggctaggaaaaccctgagcaccaatgatagngggcatctccacaatgcacgcttctgcgagaaggacctgctcctgacgatcgaccgtgaggcggtgttcgcctacgcagacgacccttgcagcaccaactacccactgatgcanaagatgcgtgcagttctcgtggagcacgccttggccaatggtgaggccgancgggatgtgcatacctnagtgttcgccaagctcgccacatttgagcaggagctccgggcggngcttccaanggagggcgagtcngcccggngcgccgtggagaatggcaccgccacncaacaaaaccgcattancgaatgccgggcataccccctttatcgnttngtgcccaaggagctgggnactgagtacttgacgggaganaanacaagggcttctggngaaaaaggggacaaaggggttttgttggtnttaancangggaaacacattnacccccttnttgagtgccttaaaggagnggaacngggaancccctgcctttttgntnaaaaangggtnaaggaactnaaaaaaaaa

SEQ ID NO: 353 - DNA, 532 bp, Lolium perenne
  misc_feature (25)..(25): n is a, c, g, or t
gtttgtgttcccctacgcagacganttttgcagcgctaactacccactgatgcagaagatgcgtgcagttctcgtggagcacgccttggccaacggtgaggctgagcgggatgtgcagacgtcagtgttcgccaagcttgccgcattcgagcaggagctccgtgcagtgcttccaagggaggttgagtcagcccggtgtgctgtggagaatggcaccgccgcgcagcaaaaccgcatcaccgaatgccggtcgtacccgctgtaccgcttcgtgcgcaaggagctcggaaccgagtacttgaccggagagaagacgaggtctcctggtgaagaggtggacaaggtgtttgtggctatgaaccaggggaaacacatcgacgcgctgcttgagtgcctcaaggagtggaatggtgagcccctgcctatctgctgaagaatgaatcaaggaactgaagaatagagtacttgagagttcagaaggctccacatgtgcttagttaataagtatagtactgttttttcattgtatctt

SEQ ID NO: 354 - DNA, 397 bp, Lolium perenne
  misc_feature (1)..(1): n is a, c, g, or t
  misc_feature (81)..(81): n is a, c, g, or t
  misc_feature (282)..(282): n is a, c, g, or t
nggaggtcgagtcagcccggtgtgccgtggagaatggcaccgccccgcagcagaatcgcatcgccgaatgccggtcatacncgttgtatcgcttcgtgcgcaaagagctcggaaccgagtacttgaccggagagaagacgaggtctcctggtgaagaggtggacaaggtgtttgtggccatgaacaagggggaacacatcgactcgctgcttgagtgcctcaaggagtggaacggtgagcccctgcctatctgctgacgaatgaatcaaggaactgaagaancagaggcttcagaatccagaaggtttcacatgtgcttagttaattagtacagtactgttttttcattgtatcttctgatgttgtcgtctgcgacgtccttctagacctgccgtac

SEQ ID NO: 355 - DNA, 1475 bp, Lolium perenne
  misc_feature (20)..(20): n is a, c, g, or t
  misc_feature (37)..(37): n is a, c, g, or t
  misc_feature (559)..(559): n is a, c, g, or t
  misc_feature (656)..(656): n is a, c, g, or t
  misc_feature (673)..(673): n is a, c, g, or t
  misc_feature (679)..(679): n is a, c, g, or t
  misc_feature (1063)..(1063): n is a, c, g, or t
  misc_feature (1356)..(1356): n is a, c, g, or t
  misc_feature (1393)..(1393): n is a, c, g, or t
  misc_feature (1454)..(1454): n is a, c, g, or t
  misc_feature (1459)..(1459): n is a, c, g, or t
gcaccacccgggctcctcgngccgcggccatcatggnacacatcctcgcgggcagcgccttcatgggccacgccaagaaggtcaacgcgatcgacacccagctcaagcccaagcaggacaggtacgcgctccgcacctcgcctcagtggctcgggccccagatcgaggtcatccgctccgccaccaagtccatcgagcgcgaggtcaactccgtcaacgacaaccccgtcatcgacgtccaccgcggcagggcgctccacggcggcaacttccagggcacgcccatcggggtgtccatggacaacacccgcctcgccatcgccaacatcggcaagctcatgttcgcgcagttctccgagctcgtcaacgagttctacaacaacgggctcacctccaacctggcgggcagccgcaacccgagcctggactacgggttcaagggcaccgagatcgccatggcgtcctactgctctgagctgcagtacctcgccaacccggtcaccaaccacgtccagagcgcggagcagcacaaccaggacgtgaactcgctcggactcanctcggcaaggaagaccgcagaggcagtggacatcctcaagatcatgtactccaactacatggtcgcgatgtgccaggccatcgacctgcgccacatngaggaaaacatgaaganagccgngaagaactgcgtcatgcaggtggccaagaggaccctgagcatgaacaacatgggcggcctccacatcgcccgcttctgcgagaaggacctgctcaccgccatcgaccgtgaggcggtcttcgcctacgccgacgacccctgcagccccaactacccactcatgcagaagctcagggctgttatgatcgagcacgccctcgccaatggcgaaggagagcgcgccctggagacatccatcttcgccaaggtcgccgagttagagcagaacatccgcgctgcactgcccaaggaggtggaggccccacccgcttccgaggagaacggcaccccgttggcgcccaacaggatcaaggaatgccgctcctacccgctctaccagttcgngcgcgaggtctgcggcaccgagtacctcaccggcgagaagacccggtcgcccggggaggagctcaacaaggtgcttgtggccatgaacgagcggaagcacatcgacccactgctcgattgcctcaaggagtggaacggcgagcccctgccactctgctgagcaagcgacgagaagaggtaacaccacaggaaaagaaatgaacacgtacaaacactgaatatagaacgtttcaagactctgaagcgcgggaggttccttcctgttatatctagatggctgccgatactcttgntgtctgtgtttctttgtagttcagttgatgttaccgntgttgtttccagctgccgtgatgccatgaacagggcaaggccggcagcttttcaaacttgngctgntgtaacttggatgttg

SEQ ID NO: 356 - DNA, 688 bp, Lolium perenne
  misc_feature (20)..(20): n is a, c, g, or t
  misc_feature (37)..(37): n is a, c, g, or t
  misc_feature (447)..(447): n is a, c, g, or t
  misc_feature (528)..(528): n is a, c, g, or t
  misc_feature (559)..(559): n is a, c, g, or t
  misc_feature (565)..(565): n is a, c, g, or t
  misc_feature (593)..(593): n is a, c, g, or t
  misc_feature (650)..(650): n is a, c, g, or t
  misc_feature (656)..(656): n is a, c, g, or t
  misc_feature (673)..(673): n is a, c, g, or t
  misc_feature (679)..(679): n is a, c, g, or t
gcaccacccgggctcctcgngccgcggccatcatggnacacatcctcgcgggcagcgccttcatgggccacgccaagaaggtcaacgcgatcgacacccagctcaagcccaagcaggacaggtacgcgctccgcacctcgcctcagtggctcgggccccagatcgaggtcatccgctccgccaccaagtccatcgagcgcgaggtcaactccgtcaacgacaaccccgtcatcgacgtccaccgcggcagggcgctccacggcggcaacttccagggcacgcccatcggggtgtccatggacaacacccgcctcgccatcgccaacatcggcaagctcatgttcgcgcagttctccgagctcgtcaacgagttctacaacaacgggctcacctccaacctggcgggcagccgcaacccgagcctggactacgggttcaagggcaccntgatcgccatggcgtcctactgctctgagctgcagtacctcgccaacccggtcaccaaccacgtccagagcgcggagcagnacaaccaggacgtgaactcgctcggactcgnctcggncaggaagaccgcggaggccgtggacatnctcaagctcatgtactgcacctacatggtggcgctgtgccaggccatcgacctgcgncacctngaggaaaacatgaaggnctgcgngaagaactg

SEQ ID NO: 357 - DNA, 634 bp, Lolium perenne
  misc_feature (18)..(18): n is a, c, g, or t
  misc_feature (176)..(176): n is a, c, g, or t
  misc_feature (399)..(399): n is a, c, g, or t
  misc_feature (413)..(413): n is a, c, g, or t
  misc_feature (440)..(440): n is a, c, g, or t
  misc_feature (470)..(470): n is a, c, g, or t
  misc_feature (503)..(503): n is a, c, g, or t
  misc_feature (545)..(545): n is a, c, g, or t
  misc_feature (560)..(560): n is a, c, g, or t
  misc_feature (576)..(576): n is a, c, g, or t
  misc_feature (581)..(581): n is a, c, g, or t
  misc_feature (623)..(623): n is a, c, g, or t
  misc_feature (625)..(625): n is a, c, g, or t
aagggtgctgagattgcntggcttcttactgctctgagctgcagttcttgggcaacccggtcaccaaccatgtccagagcgcggagcagcacaaccaggacgtgaactcgcttggtctgatctcgtcaagggagaccgcagaggcagttgacatcctcaagatcatgtcctccaanttcttggtcgctatttgccaggccattgaccttcgccacattgaggagaacatgaagatagctgtgaggaactgcgtcatgcaggtggccaagaggaccctgagcatgaacaacatgggcggcctccacatcgcccgcttctgcgagaaggacctgctcaccgccatcgaccgtgaggcggtcttcgcctacgccgacgacccctgcagccccaactacccgntcatgcagaagctnagggctgttatgatcgagcacgccctngccaatggcgaaggagagcgcgccctgganacatccattttcgccaaggtcgccgagttagancagaacatccgcgctgcactgcccaaggaggtggaggcccgnccctcttccgagganaacggcaccctgttgncgccnaacaggatcaaggaatgccgctcctacccgttttaccagttngngcgcgaggt

SEQ ID NO: 358 - DNA, 767 bp, Lolium perenne
  misc_feature (2)..(2): n is a, c, g, or t
  misc_feature (648)..(648): n is a, c, g, or t
  misc_feature (685)..(685): n is a, c, g, or t
  misc_feature (746)..(746): n is a, c, g, or t
  misc_feature (751)..(751): n is a, c, g, or t
gntccctgagcatgaacaacatgggcggcctccacatcgcccgcttctgcgagaaggacctgctcaccgccatcgaccgtgaggcggtcttcgcctacgccgacgacccctgcagccccaactacccactcatgcagaagctcagggctgttatgatcgagcacgccctcgccaatggcgaaggagagcgcgccctggagacctccatcttcgccaaggtcgccgagttcgagcagaacatccgcgctgcactgcccaaggaggtggaggccgcacgcgcttccgtggagaacggcaccccgttggcgcccaacaggatcaaggaatgccgctcctacccgctctaccagttcgtgcgcgaggtctgcggcaccgagtacctcaccggcgagaagacccggtcgcccggggaggagctcaacaaggtgcttgtggccatgaacgagcggaagcacatcgacccactgctcgattgcctcaaggagtggaacggcgagcccctgccactctgctgagcaagcgacgagaagaggtaacaccacaggaaaagaaatgaacacgtacaaacactgaatatagaacgtttcaagactctgaagcgcgggaggttccttcctgttatatctagatggctgccgatactcttgntgtctgtgtttctttgtagttcagttgatgttaccgntgttgtttccagctgccgtgatgccatgaacagggcaaggccggcagcttttcaaacttgngctgntgtaacttggatgttg

SEQ ID NO: 359 - DNA, 1539 bp, Cynodon dactylon; identical to SEQ ID NO: 227

SEQ ID NO: 360 - DNA, 789 bp, Cynodon dactylon; identical to SEQ ID NO: 231

SEQ ID NO: 361 - DNA, 1086 bp, Festuca arundinacea
atgggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctcctccatggtcgtcgaccagaagttcgtggtgaagatcccagcggggctagcgccggagcaggcggcgccgctgctgtgcgccggcgtgaccgtgtacagcccgctgaagcacttcgggctgatgaccccgggcctccgcggcggcatcctcggcctcggcggcgtcggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctcctcaagatggacggcaagctcgtcctcatgggcgtcatcggcgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgacgtcgcagggagcaacatcgacgacactgccgcgtga

SEQ ID NO: 362 - DNA, 801 bp, Festuca arundinacea
atggcgaccacggcggctgatgccacggccacggtggcaaaggagcagcagaccaccaccaacggcgccgccagcgctggcgagcaggtcacgcgccactccgaggtcggacacaagagcctgctccagagcgacgcgctctaccagtacatcctggagaccaccgtgtacccgcgcgagcacgagtgcatgaagcagctccgccaggacaccgcgaaccacccctggaacctgatgaccacgtcggcggacgagggccagttcctgaacctgctcatcaagctcatcggcgccaagaagaccatggagatcggcgtctacaccggctactccctcctcgccaccgcactcgccatccccgaagacggaaccatcttggccatggacatcaaccgcgagaactacgagaccatcggcaagccctgcatcgagaaggccggcgtcgcgcacaagatcgacttccgcgagggcccggccctcccggtcctggacgagctgctccaggacgaggccaaccacggcaccttcgacttcgtcttcgtcgacgccgacaaggacaactacctcaactaccacgagcgcctcatgaagctcgtcagggtcggcggactcctcggctactacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcacactctgccgccgcgccaagtga

SEQ ID NO: 363 - DNA, 1083 bp, Festuca arundinacea
atgggttccaccgccgccgacatggccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcgccggacatggtggaccgcatgctccggctgctcgcgtcgtacaacgtcgtgacgtgcctggtagaggagggcaaggacgggcgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatccccttcaacaaggcgtacggcatgtcggcgttcgagtaccacggcacggacccgcgcttcaaccgcgttttcaacgaagggatgaagaaccactccatcatcatcaccaagaagctcctcgagctctaccacggcttccagggcctcggcaccctcgtcgacgtcggcggcggcgtcggcgccaccgtggccgccatcgccgcccactaccccgccatcaagggggtcaacttcgacctcccccacgtcatctccgaggcgccgcagttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaagcccagctcgcagggggtcttccacgtcgacatgatcatgctcgcgcacaaccccggcggcagggagaggtacgagagggagttcgaggccctggccaggggagctgggttcaccggcgtcaagtccacgtacatctacgcaaacgcgtgggccatcgagttcaccaagtag

The invention claimed is:

1. A method of modifying lignin biosynthesis in a plant, said method including introducing into said plant in a sense orientation an effective amount of a nucleic acid comprising a fragment or variant of a gene encoding caffeic acid O-methyltransferase (COMT), said nucleic acid being capable of modifying lignin biosynthesis in a plant via sense suppression;
   wherein said fragment or variant comprises a frame shift mutation relative to the gene upon which the fragment or variant is based, resulting in a loss of or at least 50% reduction in enzymatic activity in the COMT; and
   wherein said frame shift mutation is a mutation that deletes or inserts one, two, four, five, seven or eight nucleotides within 200 bases of the 5' end of the gene upon which the fragment or variant is based and within a short distance of the ATG start codon of the gene upon which the fragment or variant is based;
   such that expression of the gene encoding COMT is suppressed; and
   wherein the nucleic acid is selected from the group consisting of SEQ ID Nos: 135, 139, 143, 147, 151, 155, 159, 163, 167 and 171; or
   wherein the nucleic acid encodes a polypeptide comprising a sequence selected from the group consisting of SEQ ID Nos: 136, 140, 144, 148, 152, 156, 160, 164, 168 and 172.

2. The method according to claim 1, wherein said gene upon which the fragment or variant is based is from a forage, turf or bioenergy grass species.

3. The method according to claim 2, wherein said gene upon which the fragment or variant is based is from a *Lolium, Festuca, Cynodon, Bracharia, Paspalum, Panicum, Miscanthus, Pennisetum,* or *Phalaris* species.

4. The method according to claim 1, wherein said gene upon which the fragment or variant is based comprises a nucleotide sequence selected from the group consisting of Sequence ID Nos: 133, 137, 141, 145, 295 to 342, 360, 362 and 363.

5. The method according to claim 1, wherein said plant is selected from the group consisting of *Lolium, Festuca, Cynodon, Bracharia, Paspalum, Panicum, Miscanthus, Pennisetum, Phalaris*, and other forage and turf grasses, corn, grains, oat, sugarcane, wheat, barley, *Arabidopsis*, tobacco, legumes, Alfalfa, oak, *Eucalyptus*, maple, *Populus*, canola, soybean, chickpea and *Pinus*.

6. The method according to claim 1, wherein said nucleic acid is part of a genetic construct or vector.

7. The method according to claim 1, wherein the nucleotides inserted or deleted are all consecutive.

8. The method according to claim 1, wherein the frame shift mutation is within 20 bases of the ATG start codon of the gene upon which the fragment or variant is based.

9. A transformed plant, plant cell, plant seed or other plant part or transformed plant biomass produced by the method according to claim 1.

* * * * *